(12) United States Patent
Cotta-Ramusino

(10) Patent No.: US 12,201,699 B2
(45) Date of Patent: Jan. 21, 2025

(54) COMPOSITIONS AND METHODS FOR PROMOTING HOMOLOGY DIRECTED REPAIR

(71) Applicant: Editas Medicine, Inc., Cambridge, MA (US)

(72) Inventor: Cecilia Cotta-Ramusino, Cambridge, MA (US)

(73) Assignee: Editas Medicine, Inc., Cambridge, MA (US)

( * ) Notice: Subject to any disclaimer, the term of this patent is extended or adjusted under 35 U.S.C. 154(b) by 66 days.

(21) Appl. No.: 17/393,575

(22) Filed: Aug. 4, 2021

(65) Prior Publication Data

US 2022/0072160 A1  Mar. 10, 2022

Related U.S. Application Data

(62) Division of application No. 15/518,105, filed as application No. PCT/US2015/055002 on Oct. 9, 2015, now abandoned.

(60) Provisional application No. 62/068,371, filed on Oct. 24, 2014, provisional application No. 62/062,815, filed on Oct. 10, 2014.

(51) Int. Cl.
| | |
|---|---|
| A61K 48/00 | (2006.01) |
| C07K 19/00 | (2006.01) |
| C12N 9/22 | (2006.01) |
| C12N 15/11 | (2006.01) |
| C12N 15/113 | (2010.01) |
| C12N 15/62 | (2006.01) |
| C12N 15/64 | (2006.01) |

(52) U.S. Cl.
CPC ...... *A61K 48/0066* (2013.01); *A61K 48/0083* (2013.01); *A61K 48/0091* (2013.01); *C07K 19/00* (2013.01); *C12N 9/22* (2013.01); *C12N 15/111* (2013.01); *C12N 15/113* (2013.01); *C12N 15/625* (2013.01); *C12N 15/64* (2013.01); *C07K 2319/20* (2013.01); *C07K 2319/80* (2013.01); *C07K 2319/85* (2013.01); *C12N 2310/20* (2017.05)

(58) Field of Classification Search
None
See application file for complete search history.

(56) References Cited

U.S. PATENT DOCUMENTS

| | | | |
|---|---|---|---|
| 8,546,553 B2 | 10/2013 | Terns et al. | |
| 8,697,359 B1 | 4/2014 | Zhang | |
| 8,771,945 B1 | 7/2014 | Zhang | |
| 8,795,965 B2 | 8/2014 | Zhang | |
| 8,865,406 B2 | 10/2014 | Zhang et al. | |
| 8,871,445 B2 | 10/2014 | Cong et al. | |
| 8,889,356 B2 | 11/2014 | Zhang | |
| 8,889,418 B2 | 11/2014 | Zhang et al. | |
| 8,895,308 B1 | 11/2014 | Zhang et al. | |
| 8,906,616 B2 | 12/2014 | Zhang et al. | |
| 8,932,814 B2 | 1/2015 | Cong et al. | |
| 8,945,839 B2 | 2/2015 | Zhang | |
| 8,993,233 B2 | 3/2015 | Zhang et al. | |
| 8,999,641 B2 | 4/2015 | Zhang et al. | |
| 9,023,649 B2 | 5/2015 | Mali et al. | |
| 9,074,199 B1 | 7/2015 | Chavez et al. | |
| 9,228,208 B2 | 1/2016 | Frendewey et al. | |
| 9,234,213 B2 | 1/2016 | Wu | |
| 9,260,723 B2 | 2/2016 | Mali et al. | |
| 9,260,752 B1 | 2/2016 | May et al. | |
| 9,267,135 B2 | 2/2016 | Church et al. | |
| 9,322,037 B2 | 4/2016 | Liu et al. | |
| 9,388,430 B2 | 7/2016 | Liu et al. | |
| 9,404,098 B2 | 8/2016 | Terns et al. | |
| 9,410,198 B2 | 8/2016 | May et al. | |
| 9,422,553 B2 | 8/2016 | Terns et al. | |
| 9,476,065 B2 | 10/2016 | Horwitz et al. | |
| 9,493,844 B2 | 11/2016 | Sastry-Dent et al. | |
| 9,512,444 B2 | 12/2016 | Chen et al. | |
| 9,512,446 B1 | 12/2016 | Joung et al. | |
| 9,528,124 B2 | 12/2016 | Fahrenkrug et al. | |
| 9,546,384 B2 | 1/2017 | Frendewey et al. | |
| 9,567,603 B2 | 2/2017 | Joung et al. | |
| 9,567,604 B2 | 2/2017 | Joung et al. | |
| 9,587,252 B2 | 3/2017 | Church et al. | |
| 9,637,739 B2 | 5/2017 | Siksnys et al. | |
| 9,663,782 B2 | 5/2017 | Yu et al. | |
| 9,688,971 B2 | 6/2017 | Doudna et al. | |

(Continued)

FOREIGN PATENT DOCUMENTS

| | | | |
|---|---|---|---|
| WO | WO-2020/003006 A2 | 1/2000 | |
| WO | WO-2020/005980 A1 | 2/2000 | |

(Continued)

OTHER PUBLICATIONS

US 10,077,445 B2, 09/2018, Doudna et al. (withdrawn)

(Continued)

*Primary Examiner* — Anand U Desai

(74) *Attorney, Agent, or Firm* — McCarter & English, LLP; Maria Laccotripe Zacharakis; Marcie B. Clarke

(57) ABSTRACT

This application provides improved methods of genome editing. Cas9 molecules can be used to create a break in a genomic region of interest. To increase the likelihood that the break is repaired by HDR (homology-directed repair), the cell can be contacted with molecules that bring a template nucleic acid in close proximity to the break, under conditions that allow the cell to repair the break using the template nucleic acid.

17 Claims, 9 Drawing Sheets

Specification includes a Sequence Listing.

(56) References Cited

U.S. PATENT DOCUMENTS

| | | |
|---|---|---|
| 9,725,714 B2 | 8/2017 | May et al. |
| 9,738,908 B2 | 8/2017 | Wu |
| 9,752,132 B2 | 9/2017 | Joung et al. |
| 9,790,490 B2 | 10/2017 | Zhang et al. |
| 9,803,194 B2 | 10/2017 | May et al. |
| 9,809,814 B1 | 11/2017 | May et al. |
| 9,822,370 B2 | 11/2017 | Musunuru et al. |
| 9,822,372 B2 | 11/2017 | Zhang et al. |
| 9,840,713 B2 | 12/2017 | Zhang |
| 9,873,894 B2 | 1/2018 | Conway et al. |
| 9,879,269 B2 | 1/2018 | Barrangou et al. |
| 9,885,026 B2 | 2/2018 | Brouns et al. |
| 9,902,974 B2 | 2/2018 | Conway et al. |
| 9,909,122 B2 | 3/2018 | May et al. |
| 9,926,545 B2 | 3/2018 | Joung et al. |
| 9,926,546 B2 | 3/2018 | Joung et al. |
| 9,944,912 B2 | 4/2018 | Joung et al. |
| 9,963,689 B2 | 5/2018 | Doudna et al. |
| 9,970,001 B2 | 5/2018 | Miller |
| 9,970,024 B2 | 5/2018 | Church et al. |
| 9,970,028 B2 | 5/2018 | Cost et al. |
| 10,041,092 B2 | 8/2018 | Horwitz et al. |
| 10,066,233 B2 | 9/2018 | Barrangou et al. |
| 10,077,453 B2 | 9/2018 | Liu et al. |
| 10,093,910 B2 | 10/2018 | Joung et al. |
| 10,100,291 B2 | 10/2018 | Chavez et al. |
| 10,113,167 B2 | 10/2018 | Doudna et al. |
| 10,113,179 B2 | 10/2018 | Begemann et al. |
| 10,113,207 B2 | 10/2018 | Wang |
| 10,119,133 B2 | 11/2018 | Joung et al. |
| 10,125,361 B2 | 11/2018 | May et al. |
| 10,155,938 B2 | 12/2018 | Stark et al. |
| 10,202,589 B2 | 2/2019 | Joung et al. |
| 10,202,619 B2 | 2/2019 | Wu |
| 10,227,611 B2 | 3/2019 | Doudna et al. |
| 10,266,850 B2 | 4/2019 | Doudna et al. |
| 10,301,651 B2 | 5/2019 | Doudna et al. |
| 10,308,961 B2 | 6/2019 | Doudna et al. |
| 10,329,587 B2 | 6/2019 | Church et al. |
| 10,351,878 B2 | 7/2019 | Doudna et al. |
| 10,358,658 B2 | 7/2019 | Doudna et al. |
| 10,358,659 B2 | 7/2019 | Doudna et al. |
| 10,377,998 B2 | 8/2019 | Zhang et al. |
| 10,378,027 B2 | 8/2019 | Joung et al. |
| 10,385,360 B2 | 8/2019 | Doudna et al. |
| 10,392,607 B2 | 8/2019 | Sternberg et al. |
| 10,400,253 B2 | 9/2019 | Doudna et al. |
| 10,407,697 B2 | 9/2019 | Doudna et al. |
| 10,415,059 B2 | 9/2019 | Joung et al. |
| 10,415,061 B2 | 9/2019 | Doudna et al. |
| 10,421,980 B2 | 9/2019 | Doudna et al. |
| 10,428,319 B2 | 10/2019 | Steinberg et al. |
| 10,428,352 B2 | 10/2019 | Doudna et al. |
| 10,435,679 B2 | 10/2019 | Chavez et al. |
| 10,435,708 B2 | 10/2019 | Mali et al. |
| 10,443,076 B2 | 10/2019 | Doudna et al. |
| 10,450,585 B2 | 10/2019 | Lee et al. |
| 10,479,982 B2 | 11/2019 | Joung et al. |
| 10,487,341 B2 | 11/2019 | Doudna et al. |
| 10,494,621 B2 | 12/2019 | Zhang et al. |
| 10,513,712 B2 | 12/2019 | Doudna et al. |
| 10,519,467 B2 | 12/2019 | Jinek et al. |
| 10,526,590 B2 | 1/2020 | Kennedy et al. |
| 10,526,591 B2 | 1/2020 | Joung et al. |
| 10,526,619 B2 | 1/2020 | Doudna et al. |
| 10,544,405 B2 | 1/2020 | Weiss et al. |
| 10,550,363 B1 | 2/2020 | Garst et al. |
| 10,550,372 B2 | 2/2020 | Konermann et al. |
| 10,550,407 B2 | 2/2020 | Doudna et al. |
| 10,563,225 B2 | 2/2020 | Church et al. |
| 10,563,227 B2 | 2/2020 | Doudna et al. |
| 10,570,415 B2 | 2/2020 | Doudna et al. |
| 10,570,418 B2 | 2/2020 | Doudna et al. |
| 10,577,631 B2 | 3/2020 | Doudna et al. |
| 10,597,680 B2 | 3/2020 | Doudna et al. |
| 10,604,752 B2 | 3/2020 | Chen et al. |
| 10,612,045 B2 | 4/2020 | Doudna et al. |
| 10,626,418 B2 | 4/2020 | Horwitz et al. |
| 10,626,419 B2 | 4/2020 | Doudna et al. |
| 10,633,626 B2 | 4/2020 | Garst et al. |
| 10,633,627 B2 | 4/2020 | Garst et al. |
| 10,633,642 B2 | 4/2020 | Joung et al. |
| 10,640,778 B2 | 5/2020 | Barrangou et al. |
| 10,640,789 B2 | 5/2020 | Church et al. |
| 10,640,791 B2 | 5/2020 | Doudna et al. |
| 10,669,540 B2 | 6/2020 | Zhang et al. |
| 10,669,560 B2 | 6/2020 | Doudna et al. |
| 10,676,759 B2 | 6/2020 | Doudna et al. |
| 10,683,490 B2 | 6/2020 | Chavez et al. |
| 10,704,033 B1 | 7/2020 | Kim et al. |
| 10,704,062 B2 | 7/2020 | Liu et al. |
| 10,711,285 B2 | 7/2020 | Zhang et al. |
| 10,717,990 B2 | 7/2020 | Mali et al. |
| 10,724,021 B1 | 7/2020 | Kim et al. |
| 10,724,050 B1 | 7/2020 | Doering et al. |
| 10,731,180 B2 | 8/2020 | Garst et al. |
| 10,731,181 B2 | 8/2020 | Chen et al. |
| 10,745,678 B1 | 8/2020 | Kim et al. |
| 10,745,714 B2 | 8/2020 | Gersbach et al. |
| 10,745,716 B2 | 8/2020 | Chen et al. |
| 10,752,920 B2 | 8/2020 | Doudna et al. |
| 10,760,064 B2 | 9/2020 | Joung et al. |
| 10,760,081 B2 | 9/2020 | Sfeir et al. |
| 10,767,168 B2 | 9/2020 | Joung et al. |
| 10,767,169 B1 | 9/2020 | Kim et al. |
| 10,767,193 B2 | 9/2020 | Seebeck et al. |
| 10,767,194 B2 | 9/2020 | Church et al. |
| 10,774,344 B1 | 9/2020 | Doudna et al. |
| 10,787,684 B2 | 9/2020 | Byrne et al. |
| 10,793,842 B2 | 10/2020 | Sternberg et al. |
| 10,793,878 B1 | 10/2020 | Doudna et al. |
| 10,808,233 B2 | 10/2020 | Joung et al. |
| 10,844,378 B2 | 11/2020 | Siksnys et al. |
| 10,851,357 B2 | 12/2020 | Davidson et al. |
| 10,851,380 B2 | 12/2020 | Kim et al. |
| 10,876,100 B2 | 12/2020 | Zhang et al. |
| 10,900,054 B2 | 1/2021 | Doudna et al. |
| 10,913,941 B2 | 2/2021 | Thomas et al. |
| 10,927,383 B2 | 2/2021 | Aneja et al. |
| 10,930,367 B2 | 2/2021 | Zhang et al. |
| 10,947,517 B2 | 3/2021 | Chen |
| 10,975,364 B2 | 4/2021 | Zheng et al. |
| 11,001,863 B2 | 5/2021 | Doudna et al. |
| 11,008,589 B2 | 5/2021 | Doudna et al. |
| 11,008,590 B2 | 5/2021 | Doudna et al. |
| 11,041,173 B2 | 6/2021 | Zhang et al. |
| 11,053,482 B2 | 7/2021 | Van Der Oost |
| 11,060,078 B2 | 7/2021 | Joung et al. |
| 11,060,083 B2 | 7/2021 | Yu et al. |
| 11,072,785 B2 | 7/2021 | Guffy et al. |
| 11,091,798 B2 | 8/2021 | Zhang et al. |
| 11,098,297 B2 | 8/2021 | Steinberg et al. |
| 11,136,567 B2 | 10/2021 | Behlke et al. |
| 11,168,313 B2 | 11/2021 | Joung et al. |
| 11,180,751 B2 | 11/2021 | Koonin et al. |
| 11,180,793 B2 | 11/2021 | Jayaram et al. |
| 11,186,849 B2 | 11/2021 | Doudna et al. |
| 11,193,141 B2 | 12/2021 | Dever et al. |
| 11,236,313 B2 | 2/2022 | Cotta-Ramusino et al. |
| 11,236,359 B2 | 2/2022 | Mali et al. |
| 11,268,078 B1 | 3/2022 | Kim et al. |
| 11,268,082 B2 | 3/2022 | Liu et al. |
| 11,286,468 B2 | 3/2022 | Joung et al. |
| 11,286,470 B2 | 3/2022 | Chavez et al. |
| 2010/0076057 A1 | 3/2010 | Sontheimer et al. |
| 2010/0093617 A1 | 4/2010 | Barrangou et al. |
| 2013/0011828 A1 | 1/2013 | Barrangou et al. |
| 2014/0068797 A1 | 3/2014 | Doudna et al. |
| 2014/0093941 A1 | 4/2014 | Terns et al. |
| 2014/0179770 A1 | 6/2014 | Zhang et al. |
| 2014/0186843 A1 | 7/2014 | Zhang et al. |
| 2014/0186919 A1 | 7/2014 | Zhang et al. |
| 2014/0186958 A1 | 7/2014 | Zhang et al. |
| 2014/0189896 A1 | 7/2014 | Zhang et al. |

(56) References Cited

U.S. PATENT DOCUMENTS

| | | |
|---|---|---|
| 2014/0199767 A1 | 7/2014 | Barrangou et al. |
| 2014/0242664 A1 | 8/2014 | Zhang et al. |
| 2014/0242699 A1 | 8/2014 | Zhang |
| 2014/0256046 A1 | 9/2014 | Zhang et al. |
| 2014/0273037 A1 | 9/2014 | Wu |
| 2014/0273226 A1 | 9/2014 | Wu |
| 2014/0273230 A1 | 9/2014 | Chen et al. |
| 2014/0273233 A1 | 9/2014 | Chen et al. |
| 2014/0287938 A1 | 9/2014 | Zhang et al. |
| 2014/0294773 A1 | 10/2014 | Brouns et al. |
| 2014/0302563 A1 | 10/2014 | Doudna et al. |
| 2014/0310830 A1 | 10/2014 | Zhang et al. |
| 2014/0315985 A1 | 10/2014 | May et al. |
| 2014/0342456 A1 | 11/2014 | Mali et al. |
| 2014/0342457 A1 | 11/2014 | Mali et al. |
| 2014/0342458 A1 | 11/2014 | Mali et al. |
| 2014/0356956 A1 | 12/2014 | Church et al. |
| 2014/0357523 A1 | 12/2014 | Zeiner et al. |
| 2014/0357530 A1 | 12/2014 | Zhang et al. |
| 2014/0377868 A1 | 12/2014 | Joung et al. |
| 2015/0020223 A1 | 1/2015 | Zhang et al. |
| 2015/0024499 A1 | 1/2015 | Brouns et al. |
| 2015/0024500 A1 | 1/2015 | Yu et al. |
| 2015/0031132 A1 | 1/2015 | Church et al. |
| 2015/0031133 A1 | 1/2015 | Church et al. |
| 2015/0031134 A1 | 1/2015 | Zhang et al. |
| 2015/0044772 A1 | 2/2015 | Zhao |
| 2015/0045546 A1 | 2/2015 | Siksnys et al. |
| 2015/0050699 A1 | 2/2015 | Siksnys et al. |
| 2015/0056705 A1 | 2/2015 | Conway et al. |
| 2015/0071889 A1 | 3/2015 | Musunuru et al. |
| 2015/0071898 A1 | 3/2015 | Liu et al. |
| 2015/0071899 A1 | 3/2015 | Liu et al. |
| 2015/0079680 A1 | 3/2015 | Bradley et al. |
| 2015/0079681 A1 | 3/2015 | Zhang |
| 2015/0128300 A1 | 5/2015 | Warming et al. |
| 2015/0140664 A1 | 5/2015 | Byrne et al. |
| 2015/0159174 A1 | 6/2015 | Frendewey et al. |
| 2015/0159175 A1 | 6/2015 | Frendewey et al. |
| 2015/0176013 A1 | 6/2015 | Musunuru et al. |
| 2015/0184139 A1 | 7/2015 | Zhang et al. |
| 2015/0184199 A1 | 7/2015 | Horwitz et al. |
| 2015/0203872 A1 | 7/2015 | Zhang |
| 2015/0232833 A1 | 8/2015 | Mali et al. |
| 2015/0232882 A1 | 8/2015 | Zhang et al. |
| 2015/0240261 A1 | 8/2015 | Siksnys et al. |
| 2015/0240263 A1 | 8/2015 | Holmes et al. |
| 2015/0247150 A1 | 9/2015 | Zhang et al. |
| 2015/0259684 A1 | 9/2015 | Church et al. |
| 2015/0259704 A1 | 9/2015 | Church et al. |
| 2015/0284727 A1 | 10/2015 | Kim et al. |
| 2015/0291961 A1 | 10/2015 | Siksnys et al. |
| 2015/0291965 A1 | 10/2015 | Zhang et al. |
| 2015/0291966 A1 | 10/2015 | Zhang et al. |
| 2015/0322457 A1 | 11/2015 | Kim et al. |
| 2015/0344912 A1 | 12/2015 | Kim et al. |
| 2015/0353905 A1 | 12/2015 | Weiss et al. |
| 2015/0353917 A1 | 12/2015 | Miller |
| 2015/0356239 A1 | 12/2015 | Zhang et al. |
| 2015/0376645 A1 | 12/2015 | Zechiedrich et al. |
| 2016/0002670 A1 | 1/2016 | Church et al. |
| 2016/0010076 A1 | 1/2016 | Joung et al. |
| 2016/0010154 A1 | 1/2016 | Laganiere et al. |
| 2016/0017366 A1 | 1/2016 | Chen et al. |
| 2016/0024523 A1 | 1/2016 | Joung et al. |
| 2016/0024524 A1 | 1/2016 | Joung et al. |
| 2016/0024529 A1 | 1/2016 | Carstens |
| 2016/0029604 A1 | 2/2016 | Fahrenkrug et al. |
| 2016/0032274 A1 | 2/2016 | Church et al. |
| 2016/0032292 A1 | 2/2016 | Storici et al. |
| 2016/0040155 A1 | 2/2016 | Maizels et al. |
| 2016/0046949 A1 | 2/2016 | May et al. |
| 2016/0046961 A1 | 2/2016 | Jinek et al. |
| 2016/0046962 A1 | 2/2016 | May et al. |
| 2016/0046963 A1 | 2/2016 | May et al. |
| 2016/0046978 A1 | 2/2016 | May et al. |
| 2016/0060653 A1 | 3/2016 | Doudna et al. |
| 2016/0060654 A1 | 3/2016 | Doudna et al. |
| 2016/0060657 A1 | 3/2016 | Frendewey et al. |
| 2016/0068864 A1 | 3/2016 | Doudna et al. |
| 2016/0068887 A1 | 3/2016 | May et al. |
| 2016/0076020 A1 | 3/2016 | May et al. |
| 2016/0090607 A1 | 3/2016 | Conway et al. |
| 2016/0102324 A1 | 4/2016 | Duchateau et al. |
| 2016/0108470 A1 | 4/2016 | May et al. |
| 2016/0115488 A1 | 4/2016 | Zhang et al. |
| 2016/0115489 A1 | 4/2016 | Zhang et al. |
| 2016/0122774 A1 | 5/2016 | Duchateau et al. |
| 2016/0130608 A1 | 5/2016 | Doudna et al. |
| 2016/0130609 A1 | 5/2016 | Doudna et al. |
| 2016/0138008 A1 | 5/2016 | Doudna et al. |
| 2016/0138046 A1 | 5/2016 | Wu |
| 2016/0145644 A1 | 5/2016 | Cost et al. |
| 2016/0145646 A1 | 5/2016 | Frendewey et al. |
| 2016/0153003 A1 | 6/2016 | Joung et al. |
| 2016/0153004 A1 | 6/2016 | Zhang et al. |
| 2016/0153006 A1 | 6/2016 | Zhang et al. |
| 2016/0160210 A1 | 6/2016 | Mali et al. |
| 2016/0160291 A1 | 6/2016 | Scully et al. |
| 2016/0168592 A1 | 6/2016 | Church et al. |
| 2016/0175462 A1 | 6/2016 | Zhang et al. |
| 2016/0177340 A1 | 6/2016 | Bradley et al. |
| 2016/0184362 A1 | 6/2016 | Duchateau et al. |
| 2016/0186152 A1 | 6/2016 | Brouns et al. |
| 2016/0186213 A1 | 6/2016 | Zhang et al. |
| 2016/0186214 A1 | 6/2016 | Brouns et al. |
| 2016/0201089 A1 | 7/2016 | Gersbach et al. |
| 2016/0207983 A1 | 7/2016 | Bradley et al. |
| 2016/0208243 A1 | 7/2016 | Zhang et al. |
| 2016/0215276 A1 | 7/2016 | Liu et al. |
| 2016/0222416 A1 | 8/2016 | Church et al. |
| 2016/0237455 A1 | 8/2016 | Glucksmann et al. |
| 2016/0237456 A1 | 8/2016 | Church et al. |
| 2016/0251640 A1 | 9/2016 | May et al. |
| 2016/0257948 A1 | 9/2016 | Bradley et al. |
| 2016/0257974 A1 | 9/2016 | Bradley et al. |
| 2016/0264995 A1 | 9/2016 | Yamamoto et al. |
| 2016/0272965 A1 | 9/2016 | Zhang et al. |
| 2016/0281072 A1 | 9/2016 | Zhang |
| 2016/0281111 A1 | 9/2016 | Cotta-Ramusino et al. |
| 2016/0298097 A1 | 10/2016 | Chavez et al. |
| 2016/0298125 A1 | 10/2016 | Chen et al. |
| 2016/0298132 A1 | 10/2016 | Chen et al. |
| 2016/0298133 A1 | 10/2016 | Chen et al. |
| 2016/0298134 A1 | 10/2016 | Chen et al. |
| 2016/0298135 A1 | 10/2016 | Chen et al. |
| 2016/0298136 A1 | 10/2016 | Chen et al. |
| 2016/0298137 A1 | 10/2016 | Chen et al. |
| 2016/0298138 A1 | 10/2016 | Chen et al. |
| 2016/0304855 A1 | 10/2016 | Stark et al. |
| 2016/0304907 A1 | 10/2016 | Mali et al. |
| 2016/0312198 A1 | 10/2016 | Joung et al. |
| 2016/0312199 A1 | 10/2016 | Joung et al. |
| 2016/0312280 A1 | 10/2016 | May et al. |
| 2016/0319260 A1 | 11/2016 | Joung et al. |
| 2016/0319261 A1 | 11/2016 | Joung et al. |
| 2016/0319281 A1 | 11/2016 | Tsai et al. |
| 2016/0319349 A1 | 11/2016 | May et al. |
| 2016/0340662 A1 | 11/2016 | Zhang et al. |
| 2016/0355796 A1 | 12/2016 | Davidson et al. |
| 2016/0355797 A1 | 12/2016 | Konermann et al. |
| 2016/0355816 A1 | 12/2016 | Terns et al. |
| 2016/0369258 A1 | 12/2016 | Maizels et al. |
| 2016/0376610 A1 | 12/2016 | Davis et al. |
| 2017/0002380 A1 | 1/2017 | Buerckstuemmer |
| 2017/0009256 A1 | 1/2017 | Buerckstuemmer |
| 2017/0016027 A1 | 1/2017 | Lee et al. |
| 2017/0029805 A1 | 2/2017 | Li et al. |
| 2017/0037416 A1 | 2/2017 | Barrangou et al. |
| 2017/0044569 A9 | 2/2017 | Church et al. |
| 2017/0051276 A1 | 2/2017 | May et al. |
| 2017/0051310 A1 | 2/2017 | Doudna et al. |
| 2017/0051312 A1 | 2/2017 | Jinek et al. |
| 2017/0058271 A1 | 3/2017 | Joung et al. |

(56) References Cited

U.S. PATENT DOCUMENTS

| | | |
|---|---|---|
| 2017/0058272 A1 | 3/2017 | Carter et al. |
| 2017/0058298 A1 | 3/2017 | Kennedy et al. |
| 2017/0058299 A1 | 3/2017 | Horwitz et al. |
| 2017/0067078 A1 | 3/2017 | Frendewey et al. |
| 2017/0073705 A1 | 3/2017 | Chen et al. |
| 2017/0081650 A1 | 3/2017 | Joung et al. |
| 2017/0107536 A1 | 4/2017 | Zhang et al. |
| 2017/0152508 A1 | 6/2017 | Joung et al. |
| 2017/0152528 A1 | 6/2017 | Zhang |
| 2017/0166875 A1 | 6/2017 | Maizels et al. |
| 2017/0166893 A1 | 6/2017 | Doudna et al. |
| 2017/0166903 A1 | 6/2017 | Zhang et al. |
| 2017/0175140 A1 | 6/2017 | Hummel et al. |
| 2017/0175142 A1 | 6/2017 | Zhang et al. |
| 2017/0175144 A1 | 6/2017 | Zhang et al. |
| 2017/0191078 A1 | 7/2017 | Zhang et al. |
| 2017/0191082 A1 | 7/2017 | Chen et al. |
| 2017/0198269 A1 | 7/2017 | Zhang et al. |
| 2017/0198277 A1 | 7/2017 | Kmiec et al. |
| 2017/0198302 A1 | 7/2017 | Feng et al. |
| 2017/0211142 A1 | 7/2017 | Smargon et al. |
| 2017/0233703 A1 | 8/2017 | Xie et al. |
| 2017/0251647 A1 | 9/2017 | Mashimo et al. |
| 2017/0260547 A1 | 9/2017 | Dombrowski et al. |
| 2017/0268022 A1 | 9/2017 | Liu et al. |
| 2017/0273284 A1 | 9/2017 | Shen |
| 2017/0275611 A1 | 9/2017 | Bradley et al. |
| 2017/0298330 A1 | 10/2017 | Sato et al. |
| 2017/0306306 A1 | 10/2017 | Potter et al. |
| 2017/0306307 A1 | 10/2017 | Zhang et al. |
| 2017/0306335 A1 | 10/2017 | Zhang et al. |
| 2017/0327805 A1 | 11/2017 | Joung et al. |
| 2017/0327806 A1 | 11/2017 | Joung et al. |
| 2017/0327820 A1 | 11/2017 | May et al. |
| 2017/0349915 A1 | 12/2017 | May et al. |
| 2017/0362611 A1 | 12/2017 | Tsai |
| 2018/0002682 A1 | 1/2018 | Sternberg et al. |
| 2018/0016601 A1 | 1/2018 | Qi et al. |
| 2018/0030425 A1 | 2/2018 | Joung et al. |
| 2018/0044700 A1 | 2/2018 | Doudna et al. |
| 2018/0049412 A1 | 2/2018 | Shen |
| 2018/0051298 A1 | 2/2018 | Fahrenkrug et al. |
| 2018/0066242 A1 | 3/2018 | Zhang et al. |
| 2018/0073002 A1 | 3/2018 | Deiters et al. |
| 2018/0073039 A1 | 3/2018 | Durocher et al. |
| 2018/0080051 A1 | 3/2018 | Sheikh et al. |
| 2018/0100148 A1 | 4/2018 | Vakulskas et al. |
| 2018/0105564 A1 | 4/2018 | Davis et al. |
| 2018/0112235 A1 | 4/2018 | Li et al. |
| 2018/0119121 A1 | 5/2018 | Brouns et al. |
| 2018/0119175 A1 | 5/2018 | Conway et al. |
| 2018/0127780 A1 | 5/2018 | Liu et al. |
| 2018/0127785 A1 | 5/2018 | Junge et al. |
| 2018/0127787 A1 | 5/2018 | Gurumurthy et al. |
| 2018/0135073 A1 | 5/2018 | Chen et al. |
| 2018/0142262 A1 | 5/2018 | Webber et al. |
| 2018/0148735 A1 | 5/2018 | Begemann et al. |
| 2018/0155708 A1 | 6/2018 | Church et al. |
| 2018/0155716 A1 | 6/2018 | Zhang et al. |
| 2018/0163188 A1 | 6/2018 | Xie et al. |
| 2018/0163213 A1 | 6/2018 | Aneja et al. |
| 2018/0187176 A1 | 7/2018 | Behlke et al. |
| 2018/0187195 A1 | 7/2018 | Siksnys et al. |
| 2018/0208931 A1 | 7/2018 | Doudna et al. |
| 2018/0216088 A1 | 8/2018 | Joung et al. |
| 2018/0216135 A1 | 8/2018 | Tsai et al. |
| 2018/0230494 A1 | 8/2018 | Joung et al. |
| 2018/0230495 A1 | 8/2018 | Doudna et al. |
| 2018/0230496 A1 | 8/2018 | Doudna et al. |
| 2018/0230497 A1 | 8/2018 | Doudna et al. |
| 2018/0235194 A1 | 8/2018 | Fahrenkrug et al. |
| 2018/0237801 A1 | 8/2018 | Doudna et al. |
| 2018/0245100 A1 | 8/2018 | Doudna et al. |
| 2018/0245101 A1 | 8/2018 | Doudna et al. |
| 2018/0250424 A1 | 9/2018 | Cotta-Ramusino |
| 2018/0251791 A1 | 9/2018 | Doudna et al. |
| 2018/0251793 A1 | 9/2018 | Doudna et al. |
| 2018/0251794 A1 | 9/2018 | Doudna et al. |
| 2018/0251795 A1 | 9/2018 | Charpentier et al. |
| 2018/0265864 A1 | 9/2018 | Li et al. |
| 2018/0273932 A1 | 9/2018 | Bothmer et al. |
| 2018/0273981 A1 | 9/2018 | Doudna et al. |
| 2018/0282713 A1 | 10/2018 | Van Der Oost |
| 2018/0282714 A1 | 10/2018 | Joung et al. |
| 2018/0282764 A1 | 10/2018 | Jinek et al. |
| 2018/0291383 A1 | 10/2018 | Musunuru et al. |
| 2018/0298360 A1 | 10/2018 | Sternberg et al. |
| 2018/0298392 A1 | 10/2018 | Cotta-Ramusino |
| 2018/0298406 A1 | 10/2018 | Doudna et al. |
| 2018/0298407 A1 | 10/2018 | Doudna et al. |
| 2018/0305697 A1 | 10/2018 | Sfeir et al. |
| 2018/0305718 A1 | 10/2018 | Nelson et al. |
| 2018/0305719 A1 | 10/2018 | Perez-Pinera et al. |
| 2018/0312824 A1 | 11/2018 | Zhang et al. |
| 2018/0312874 A1 | 11/2018 | Doudna et al. |
| 2018/0312875 A1 | 11/2018 | Doudna et al. |
| 2018/0312876 A1 | 11/2018 | Doudna et al. |
| 2018/0320163 A1 | 11/2018 | Koonin et al. |
| 2018/0320197 A1 | 11/2018 | Gersbach et al. |
| 2018/0320201 A1 | 11/2018 | Vakulskas et al. |
| 2018/0327761 A1 | 11/2018 | Duchateau et al. |
| 2018/0346927 A1 | 12/2018 | Doudna et al. |
| 2018/0355332 A1 | 12/2018 | Steinberg et al. |
| 2019/0002889 A1 | 1/2019 | Cheng et al. |
| 2019/0002921 A1 | 1/2019 | Doudna et al. |
| 2019/0002922 A1 | 1/2019 | Doudna et al. |
| 2019/0002923 A1 | 1/2019 | Doudna et al. |
| 2019/0010471 A1 | 1/2019 | Zhang et al. |
| 2019/0010481 A1 | 1/2019 | Joung et al. |
| 2019/0010520 A1 | 1/2019 | Doudna et al. |
| 2019/0032091 A1 | 1/2019 | Dever et al. |
| 2019/0048340 A1 | 2/2019 | Charpentier et al. |
| 2019/0062734 A1 | 2/2019 | Cotta-Ramusino et al. |
| 2019/0062790 A1 | 2/2019 | Doudna et al. |
| 2019/0071688 A1 | 3/2019 | Begemann et al. |
| 2019/0083656 A1 | 3/2019 | Khalili et al. |
| 2019/0085329 A1 | 3/2019 | Siksnys |
| 2019/0093129 A1 | 3/2019 | Doudna et al. |
| 2019/0106687 A1 | 4/2019 | Joung et al. |
| 2019/0106711 A1 | 4/2019 | Doudna et al. |
| 2019/0106712 A1 | 4/2019 | Doudna et al. |
| 2019/0106713 A1 | 4/2019 | Doudna et al. |
| 2019/0106714 A1 | 4/2019 | Doudna et al. |
| 2019/0106715 A1 | 4/2019 | Doudna et al. |
| 2019/0136210 A1 | 5/2019 | Cotta-Ramusino et al. |
| 2019/0218602 A1 | 7/2019 | Zhang et al. |
| 2019/0264186 A1 | 8/2019 | Yamano et al. |
| 2019/0284583 A1 | 9/2019 | Doudna et al. |
| 2019/0367949 A1 | 12/2019 | Crawley et al. |
| 2019/0374576 A1 | 12/2019 | Henley et al. |
| 2019/0382799 A1 | 12/2019 | Henley et al. |
| 2020/0010817 A1 | 1/2020 | Van Der Oost |
| 2020/0056164 A1 | 2/2020 | Steinberg et al. |
| 2020/0109382 A1 | 4/2020 | Zhang et al. |
| 2020/0149020 A1 | 5/2020 | Cereseto et al. |
| 2020/0149021 A1 | 5/2020 | Li et al. |
| 2020/0149022 A1 | 5/2020 | Kim et al. |
| 2020/0157574 A1 | 5/2020 | Garst et al. |
| 2020/0157575 A1 | 5/2020 | Garst et al. |
| 2020/0165636 A1 | 5/2020 | Cotta-Ramusino et al. |
| 2020/0172564 A1 | 6/2020 | Dombrowski |
| 2020/0172935 A1 | 6/2020 | Dong et al. |
| 2020/0208141 A1 | 7/2020 | Sanjana |
| 2020/0216825 A1 | 7/2020 | Vakulskas et al. |
| 2020/0231952 A1 | 7/2020 | Gordon et al. |
| 2020/0299660 A1 | 9/2020 | Doudna et al. |
| 2020/0318172 A1 | 10/2020 | Zhang et al. |
| 2020/0318173 A1 | 10/2020 | Zhang et al. |
| 2020/0332273 A1 | 10/2020 | Thomas et al. |
| 2020/0332274 A1 | 10/2020 | Thomas et al. |
| 2021/0040506 A1 | 2/2021 | Glucksmann et al. |
| 2021/0047647 A1 | 2/2021 | Kim et al. |
| 2021/0054353 A1 | 2/2021 | Cohnen et al. |
| 2021/0062169 A1 | 3/2021 | Zheng et al. |

(56) References Cited

U.S. PATENT DOCUMENTS

| | | |
|---|---|---|
| 2021/0079427 A1 | 3/2021 | Chen et al. |
| 2021/0115421 A1 | 4/2021 | Watts et al. |
| 2021/0130835 A1 | 5/2021 | Watts et al. |
| 2021/0130838 A1 | 5/2021 | Qi et al. |
| 2021/0163907 A1 | 6/2021 | Nureki et al. |
| 2021/0163944 A1 | 6/2021 | Zhang et al. |
| 2021/0207165 A1 | 7/2021 | Chen et al. |
| 2021/0207173 A1 | 7/2021 | Chen et al. |
| 2021/0214697 A1 | 7/2021 | Doudna et al. |
| 2021/0230567 A1 | 7/2021 | Stella et al. |
| 2021/0238567 A1 | 8/2021 | Doudna et al. |
| 2021/0238598 A1 | 8/2021 | Kim et al. |
| 2021/0246473 A1 | 8/2021 | Qin |
| 2021/0269788 A1 | 9/2021 | Joung et al. |
| 2021/0292722 A1 | 9/2021 | Choe et al. |
| 2021/0292747 A1 | 9/2021 | Gill et al. |
| 2021/0324356 A1 | 10/2021 | Doudna et al. |
| 2021/0324358 A1 | 10/2021 | Doudna et al. |
| 2021/0348144 A1 | 11/2021 | Zhang et al. |
| 2021/0348156 A1 | 11/2021 | Koonin et al. |
| 2021/0348157 A1 | 11/2021 | Koonin et al. |
| 2022/0002693 A1 | 1/2022 | Behlke et al. |
| 2022/0025408 A1 | 1/2022 | Dever et al. |
| 2022/0025409 A1 | 1/2022 | Dever et al. |
| 2022/0056437 A1 | 2/2022 | Rettig et al. |
| 2022/0098572 A1 | 3/2022 | Slaymaker et al. |

FOREIGN PATENT DOCUMENTS

| | | |
|---|---|---|
| WO | WO-2020/014577 A1 | 1/2001 |
| WO | WO-2020/030984 A2 | 1/2003 |
| WO | WO-2020/032711 A1 | 1/2003 |
| WO | WO-2020/033601 A1 | 1/2003 |
| WO | WO-2020/033774 A1 | 1/2003 |
| WO | WO-2007/025097 A2 | 3/2007 |
| WO | WO-2010/011961 A2 | 1/2010 |
| WO | WO-2013/098244 A1 | 7/2013 |
| WO | WO-2013/141680 A1 | 9/2013 |
| WO | WO-2013/142578 A1 | 9/2013 |
| WO | WO-2013/176772 A1 | 11/2013 |
| WO | WO-2013/188522 A2 | 12/2013 |
| WO | WO-2014/018423 A2 | 1/2014 |
| WO | WO-2014/065596 A1 | 5/2014 |
| WO | WO-2014/089290 A1 | 6/2014 |
| WO | WO-2014/093479 A1 | 6/2014 |
| WO | WO-2014/093595 A1 | 6/2014 |
| WO | WO-2014/093622 A2 | 6/2014 |
| WO | WO-2014/093635 A1 | 6/2014 |
| WO | WO-2014/093655 A2 | 6/2014 |
| WO | WO-2014/093661 A2 | 6/2014 |
| WO | WO-2014/093694 A1 | 6/2014 |
| WO | WO-2014/093701 A1 | 6/2014 |
| WO | WO-2014/093709 A1 | 6/2014 |
| WO | WO-2014/093712 A1 | 6/2014 |
| WO | WO-2014/093718 A1 | 6/2014 |
| WO | WO-2014/099744 A1 | 6/2014 |
| WO | WO-2014/099750 A2 | 6/2014 |
| WO | WO-2014/113493 A1 | 7/2014 |
| WO | WO-2014/127287 A1 | 8/2014 |
| WO | WO-2014/143381 A1 | 9/2014 |
| WO | WO-2014/144288 A1 | 9/2014 |
| WO | WO-2014/144592 A2 | 9/2014 |
| WO | WO-2014/144761 A2 | 9/2014 |
| WO | WO-2014/145599 A2 | 9/2014 |
| WO | WO-2014/150624 A1 | 9/2014 |
| WO | WO-2014/152432 A2 | 9/2014 |
| WO | WO-2014/165825 A2 | 10/2014 |
| WO | WO-2014/172458 A1 | 10/2014 |
| WO | WO-2014/186585 A2 | 11/2014 |
| WO | WO-2014/191518 A1 | 12/2014 |
| WO | WO-2014/191521 A2 | 12/2014 |
| WO | WO-2014/197568 A2 | 12/2014 |
| WO | WO-2014/197748 A2 | 12/2014 |
| WO | WO-2014/204578 A1 | 12/2014 |
| WO | WO-2014/204724 A1 | 12/2014 |
| WO | WO-2014/204725 A1 | 12/2014 |
| WO | WO-2014/204727 A1 | 12/2014 |
| WO | WO-2014/204728 A1 | 12/2014 |
| WO | WO-2014/204729 A1 | 12/2014 |
| WO | WO-2015/006290 A1 | 1/2015 |
| WO | WO-2015/006294 A2 | 1/2015 |
| WO | WO-2015/010114 A1 | 1/2015 |
| WO | WO-2015/013583 A2 | 1/2015 |
| WO | WO-2015/021426 A1 | 2/2015 |
| WO | WO-2015/035162 A2 | 3/2015 |
| WO | WO-2015/040402 A1 | 3/2015 |
| WO | WO-2015/048577 A2 | 4/2015 |
| WO | WO-2015/077290 A2 | 5/2015 |
| WO | WO-2015/077318 A1 | 5/2015 |
| WO | WO-2015/079056 A1 | 6/2015 |
| WO | WO-2015/088643 A1 | 6/2015 |
| WO | WO-2015/089351 A1 | 6/2015 |
| WO | WO-2015/089354 A1 | 6/2015 |
| WO | WO-2015/089427 A1 | 6/2015 |
| WO | WO-2015/089486 A2 | 6/2015 |
| WO | WO-2015/095804 A1 | 6/2015 |
| WO | WO-2015/127439 A1 | 8/2015 |
| WO | WO-2015/138620 A1 | 9/2015 |
| WO | WO-2015/160683 A1 | 10/2015 |
| WO | WO-2015/168125 A1 | 11/2015 |
| WO | WO-2015/188056 A1 | 12/2015 |
| WO | WO-2015/188065 A1 | 12/2015 |
| WO | WO-2016/022363 A2 | 2/2016 |
| WO | WO-2016/025759 A1 | 2/2016 |
| WO | WO-2016/028682 A1 | 2/2016 |
| WO | WO-2016/036754 A1 | 3/2016 |
| WO | WO-2016/054326 A1 | 4/2016 |
| WO | WO-2016/057821 A2 | 4/2016 |
| WO | WO-2016/057961 A1 | 4/2016 |
| WO | WO-2016/065364 A1 | 4/2016 |
| WO | WO-2016/073990 A2 | 5/2016 |
| WO | WO-2016/081923 A2 | 5/2016 |
| WO | WO-2016/090385 A1 | 6/2016 |
| WO | WO-2016/100819 A1 | 6/2016 |
| WO | WO-2016/106236 A1 | 6/2016 |
| WO | WO-2016/106244 A1 | 6/2016 |
| WO | WO-2016/112242 A1 | 7/2016 |
| WO | WO-2016/114972 A1 | 7/2016 |
| WO | WO-2016/115326 A1 | 7/2016 |
| WO | WO-2016/138574 A1 | 9/2016 |
| WO | WO-2016/141224 A1 | 9/2016 |
| WO | WO-2016/142719 A1 | 9/2016 |
| WO | WO-2016/154579 A2 | 9/2016 |
| WO | WO-2016/161207 A1 | 10/2016 |
| WO | WO-2016/164797 A1 | 10/2016 |
| WO | WO-2016/166340 A1 | 10/2016 |
| WO | WO-2016/167300 A1 | 10/2016 |
| WO | WO-2016/183448 A1 | 11/2016 |
| WO | WO-2016/195598 A1 | 12/2016 |
| WO | WO-2016/196655 A1 | 12/2016 |
| WO | WO-2016/196887 A1 | 12/2016 |
| WO | WO-2016/205613 A1 | 12/2016 |
| WO | WO-2016/205711 A1 | 12/2016 |
| WO | WO-2016/205749 A1 | 12/2016 |
| WO | WO-2016/205759 A1 | 12/2016 |
| WO | WO-2016/210271 A1 | 12/2016 |
| WO | WO-2017/011519 A1 | 1/2017 |
| WO | WO-2017/015015 A1 | 1/2017 |
| WO | WO-2017/015101 A1 | 1/2017 |
| WO | WO-2017/031483 A1 | 2/2017 |
| WO | WO-2017/040348 A1 | 3/2017 |
| WO | WO-2017/040511 A1 | 3/2017 |
| WO | WO-2017/040709 A1 | 3/2017 |
| WO | WO-2017/048969 A1 | 3/2017 |
| WO | WO-2017/053729 A1 | 3/2017 |
| WO | WO-2017/053879 A1 | 3/2017 |
| WO | WO-2017/062754 A1 | 4/2017 |
| WO | WO-2017/064546 A1 | 4/2017 |
| WO | WO-2017/066588 A2 | 4/2017 |
| WO | WO-2017/070633 A2 | 4/2017 |
| WO | WO-2017/074962 A1 | 5/2017 |
| WO | WO-2017/096041 A1 | 6/2017 |
| WO | WO-2017/099494 A1 | 6/2017 |
| WO | WO-2017/123609 A1 | 7/2017 |

(56) References Cited

FOREIGN PATENT DOCUMENTS

| | | |
|---|---|---|
| WO | WO-2017/127807 A1 | 7/2017 |
| WO | WO-2017/129811 A1 | 8/2017 |
| WO | WO-2017/136335 A1 | 8/2017 |
| WO | WO-2017/142923 A1 | 8/2017 |
| WO | WO-2017/147056 A1 | 8/2017 |
| WO | WO-2017/160752 A1 | 9/2017 |
| WO | WO-2017/161068 A1 | 9/2017 |
| WO | WO-2017/165655 A1 | 9/2017 |
| WO | WO-2017/165826 A1 | 9/2017 |
| WO | WO-2017/172775 A1 | 10/2017 |
| WO | WO-2017/180694 A1 | 10/2017 |
| WO | WO-2017/180711 A1 | 10/2017 |
| WO | WO-2017/181107 A2 | 10/2017 |
| WO | WO-2017/184768 A1 | 10/2017 |
| WO | WO-2017/186550 A1 | 11/2017 |
| WO | WO-2017/186718 A1 | 11/2017 |
| WO | WO-2017/189308 A1 | 11/2017 |
| WO | WO-2017/189336 A1 | 11/2017 |
| WO | WO-2017/197238 A1 | 11/2017 |
| WO | WO-2017/201311 A2 | 11/2017 |
| WO | WO-2017/205650 A1 | 11/2017 |
| WO | WO-2017/207589 A1 | 12/2017 |
| WO | WO-2017/212264 A1 | 12/2017 |
| WO | WO-2017/215648 A1 | 12/2017 |
| WO | WO-2017/216771 A2 | 12/2017 |
| WO | WO-2017/219027 A1 | 12/2017 |
| WO | WO-2017/219033 A1 | 12/2017 |
| WO | WO-2017/220527 A1 | 12/2017 |
| WO | WO-2017/222773 A1 | 12/2017 |
| WO | WO-2018/013840 A1 | 1/2018 |
| WO | WO-2018/013932 A1 | 1/2018 |
| WO | WO-2018/015936 A2 | 1/2018 |
| WO | WO-2018/022634 A1 | 2/2018 |
| WO | WO-2018/025206 A1 | 2/2018 |
| WO | WO-2018/030208 A1 | 2/2018 |
| WO | WO-2018/030457 A1 | 2/2018 |
| WO | WO-2018/033110 A1 | 2/2018 |
| WO | WO-2018/035387 A1 | 2/2018 |
| WO | WO-2018/035388 A1 | 2/2018 |
| WO | WO-2018/035423 A1 | 2/2018 |
| WO | WO-2018/049073 A1 | 3/2018 |
| WO | WO-2018/049077 A1 | 3/2018 |
| WO | WO-2018/049079 A1 | 3/2018 |
| WO | WO-2018/049168 A1 | 3/2018 |
| WO | WO-2018/052247 A1 | 3/2018 |
| WO | WO-2018/053053 A1 | 3/2018 |
| WO | WO-2018/064352 A1 | 4/2018 |
| WO | WO-2018/064371 A1 | 4/2018 |
| WO | WO-2018/068053 A2 | 4/2018 |
| WO | WO-2018/069474 A1 | 4/2018 |
| WO | WO-2018/071663 A1 | 4/2018 |
| WO | WO-2018/071868 A1 | 4/2018 |
| WO | WO-2018/071892 A1 | 4/2018 |
| WO | WO-2018/074979 A1 | 4/2018 |
| WO | WO-2018/081470 A1 | 5/2018 |
| WO | WO-2018/081476 A2 | 5/2018 |
| WO | WO-2018/089437 A1 | 5/2018 |
| WO | WO-2018/089664 A1 | 5/2018 |
| WO | WO-2018/096356 A1 | 5/2018 |
| WO | WO-2018/097257 A1 | 5/2018 |
| WO | WO-2018/098383 A1 | 5/2018 |
| WO | WO-2018/108272 A1 | 6/2018 |
| WO | WO-2018/108338 A1 | 6/2018 |
| WO | WO-2018/108339 A1 | 6/2018 |
| WO | WO-2018/109101 A1 | 6/2018 |
| WO | WO-2018/112451 A1 | 6/2018 |
| WO | WO-2018/119060 A1 | 6/2018 |
| WO | WO-2018/138385 A1 | 8/2018 |
| WO | WO-2018/144546 A1 | 8/2018 |
| WO | WO-2018/149888 A1 | 8/2018 |
| WO | WO-2018/152325 A1 | 8/2018 |
| WO | WO-2018/162702 A1 | 9/2018 |
| WO | WO-2018/170015 A1 | 9/2018 |
| WO | WO-2018/172556 A1 | 9/2018 |
| WO | WO-2018/175872 A1 | 9/2018 |
| WO | WO-2018/188571 A1 | 10/2018 |
| WO | WO-2018/191715 A2 | 10/2018 |
| WO | WO-2018/195313 A1 | 10/2018 |
| WO | WO-2018/195418 A1 | 10/2018 |
| WO | WO-2018/195540 A1 | 10/2018 |
| WO | WO-2018/195545 A2 | 10/2018 |
| WO | WO-2018/195555 A1 | 10/2018 |
| WO | WO-2018/197020 A1 | 11/2018 |
| WO | WO-2018/197495 A1 | 11/2018 |
| WO | WO-2018/209712 A1 | 11/2018 |
| WO | WO-2018/213351 A1 | 11/2018 |
| WO | WO-2018/221685 A1 | 12/2018 |
| WO | WO-2018/226853 A1 | 12/2018 |
| WO | WO-2018/226855 A1 | 12/2018 |
| WO | WO-2018/227114 A1 | 12/2018 |
| WO | WO-2019/006471 A2 | 1/2019 |
| WO | WO-2019/009682 A2 | 1/2019 |
| WO | WO-2019/014564 A1 | 1/2019 |
| WO | WO-2019/018041 A1 | 1/2019 |
| WO | WO-2019/036513 A1 | 2/2019 |
| WO | WO-2019/040650 A1 | 2/2019 |
| WO | WO-2019/046540 A1 | 3/2019 |
| WO | WO-2019/049913 A1 | 3/2019 |
| WO | WO-2019/051419 A1 | 3/2019 |
| WO | WO-2019/060469 A2 | 3/2019 |
| WO | WO-2019/067322 A1 | 4/2019 |
| WO | WO-2019/072596 A1 | 4/2019 |
| WO | WO-2019/074542 A1 | 4/2019 |
| WO | WO-2019/089796 A1 | 5/2019 |
| WO | WO-2019/089804 A1 | 5/2019 |
| WO | WO-2019/089808 A1 | 5/2019 |
| WO | WO-2019/089820 A1 | 5/2019 |
| WO | WO-2019/090173 A1 | 5/2019 |
| WO | WO-2019/090174 A1 | 5/2019 |
| WO | WO-2019/090175 A1 | 5/2019 |
| WO | WO-2019/092042 A1 | 5/2019 |
| WO | WO-2019/099943 A1 | 5/2019 |
| WO | WO-2019/126709 A1 | 6/2019 |
| WO | WO-2019/126716 A1 | 6/2019 |
| WO | WO-2019/126762 A2 | 6/2019 |
| WO | WO-2019/126774 A1 | 6/2019 |
| WO | WO-2019/152519 A1 | 8/2019 |
| WO | WO-2019/168953 A1 | 9/2019 |
| WO | WO-2019/178427 A1 | 9/2019 |
| WO | WO-2019/178428 A1 | 9/2019 |
| WO | WO-2019/183150 A1 | 9/2019 |
| WO | WO-2019/233990 A1 | 12/2019 |
| WO | WO-2019/238772 A1 | 12/2019 |
| WO | WO-2019/239361 A1 | 12/2019 |
| WO | WO-2020/041751 A1 | 2/2020 |
| WO | WO-2020/047353 A1 | 3/2020 |
| WO | WO-2020/069029 A1 | 4/2020 |
| WO | WO-2020/081843 A1 | 4/2020 |
| WO | WO-2020/082042 A2 | 4/2020 |
| WO | WO-2020/085441 A1 | 4/2020 |
| WO | WO-2020/091069 A1 | 5/2020 |
| WO | WO-2020/092611 A1 | 5/2020 |
| WO | WO-2020/111983 A2 | 6/2020 |
| WO | WO-2020/111984 A2 | 6/2020 |
| WO | WO-2020/127272 A1 | 6/2020 |
| WO | WO-2020/131862 A1 | 6/2020 |
| WO | WO-2020/142754 A2 | 7/2020 |
| WO | WO-2020/146290 A1 | 7/2020 |
| WO | WO-2020/163307 A1 | 8/2020 |
| WO | WO-2020/168234 A1 | 8/2020 |
| WO | WO-2020/168291 A1 | 8/2020 |
| WO | WO-2020/172502 A1 | 8/2020 |
| WO | WO-2020/176740 A1 | 9/2020 |
| WO | WO-2020/180699 A1 | 9/2020 |
| WO | WO-2020/181101 A1 | 9/2020 |
| WO | WO-2020/181102 A1 | 9/2020 |
| WO | WO-2020/182941 A1 | 9/2020 |
| WO | WO-2020/186059 A2 | 9/2020 |
| WO | WO-2020/191102 A1 | 9/2020 |
| WO | WO-2020/198641 A2 | 10/2020 |
| WO | WO-2020/209959 A1 | 10/2020 |
| WO | WO-2020/218657 A1 | 10/2020 |
| WO | WO-2020/219908 A1 | 10/2020 |
| WO | WO-2020/223514 A2 | 11/2020 |

(56) References Cited

FOREIGN PATENT DOCUMENTS

| | | |
|---|---|---|
| WO | WO-2020/223553 A2 | 11/2020 |
| WO | WO-2020/225719 A1 | 11/2020 |
| WO | WO-2020/254872 A2 | 12/2020 |
| WO | WO-2020/264254 A1 | 12/2020 |
| WO | WO-2021/007177 A1 | 1/2021 |
| WO | WO-2021/007563 A1 | 1/2021 |
| WO | WO-2021/030344 A1 | 2/2021 |
| WO | WO-2021/031085 A1 | 2/2021 |
| WO | WO-2021/046526 A1 | 3/2021 |
| WO | WO-2021/050512 A1 | 3/2021 |
| WO | WO-2021/050534 A1 | 3/2021 |
| WO | WO-2021/050755 A1 | 3/2021 |
| WO | WO-2021/055874 A1 | 3/2021 |
| WO | WO-2021/062410 A2 | 4/2021 |
| WO | WO-2021/075827 A1 | 4/2021 |
| WO | WO-2021/081384 A1 | 4/2021 |
| WO | WO-2021/084533 A1 | 5/2021 |
| WO | WO-2021/093752 A1 | 5/2021 |
| WO | WO-2021/097118 A1 | 5/2021 |
| WO | WO-2021/100731 A1 | 5/2021 |
| WO | WO-2021/108269 A1 | 6/2021 |
| WO | WO-2021/108324 A1 | 6/2021 |
| WO | WO-2021/113522 A1 | 6/2021 |
| WO | WO-2021/118626 A1 | 6/2021 |
| WO | WO-2021/119563 A1 | 6/2021 |
| WO | WO-2021/127238 A1 | 6/2021 |
| WO | WO-2021/133829 A1 | 7/2021 |
| WO | WO-2021/138247 A1 | 7/2021 |
| WO | WO-2021/138469 A1 | 7/2021 |
| WO | WO-2021/138480 A1 | 7/2021 |
| WO | WO-2021/144692 A1 | 7/2021 |
| WO | WO-2021/146641 A1 | 7/2021 |
| WO | WO-2021/151073 A2 | 7/2021 |
| WO | WO-2021/151085 A2 | 7/2021 |
| WO | WO-2021/155109 A1 | 8/2021 |
| WO | WO-2021/171048 A1 | 9/2021 |
| WO | WO-2021/173359 A1 | 9/2021 |
| WO | WO-2021/178933 A2 | 9/2021 |
| WO | WO-2021/178934 A1 | 9/2021 |
| WO | WO-2021/183771 A1 | 9/2021 |
| WO | WO-2021/183783 A1 | 9/2021 |
| WO | WO-2021/183807 A1 | 9/2021 |
| WO | WO-2021/202559 A1 | 10/2021 |
| WO | WO-2021/202568 A1 | 10/2021 |
| WO | WO-2021/202800 A1 | 10/2021 |
| WO | WO-2021/217002 A1 | 10/2021 |
| WO | WO-2021/222703 A2 | 11/2021 |
| WO | WO-2021/226363 A1 | 11/2021 |
| WO | WO-2021/226369 A1 | 11/2021 |
| WO | WO-2021/231437 A1 | 11/2021 |
| WO | WO-2021/234388 A1 | 11/2021 |
| WO | WO-2021/234389 A1 | 11/2021 |
| WO | WO-2021/247924 A1 | 12/2021 |
| WO | WO-2021/248016 A2 | 12/2021 |
| WO | WO-2021/257716 A2 | 12/2021 |
| WO | WO-2022/017633 A2 | 1/2022 |
| WO | WO-2022/026346 A2 | 2/2022 |
| WO | WO-2022/034374 A2 | 2/2022 |
| WO | WO-2022/040148 A2 | 2/2022 |
| WO | WO-2022/040287 A1 | 2/2022 |
| WO | WO-2022/040909 A1 | 3/2022 |
| WO | WO-2022/042557 A1 | 3/2022 |
| WO | WO-2022/043598 A1 | 3/2022 |
| WO | WO-2022/046669 A2 | 3/2022 |
| WO | WO-2022/047003 A1 | 3/2022 |
| WO | WO-2022/047135 A1 | 3/2022 |
| WO | WO-2022/051250 A1 | 3/2022 |
| WO | WO-2022/055998 A1 | 3/2022 |
| WO | WO-2022/056301 A1 | 3/2022 |
| WO | WO-2022/056324 A1 | 3/2022 |
| WO | WO-2022/059928 A1 | 3/2022 |
| WO | WO-2022/060185 A1 | 3/2022 |
| WO | WO-2022/061247 A2 | 3/2022 |
| WO | WO-2022/061748 A1 | 3/2022 |
| WO | WO-2022/065867 A1 | 3/2022 |

OTHER PUBLICATIONS

Zhou et al., "Cas12a variants designed for lower genome-wide off-target effects through stringent PAM recognition", Molecular Therapy vol. 30, No. 1, Jan. 2022 pp. 1-12 (Year: 2021).*

Song et al., "Delivery of CRISPR/Cas systems for cancer gene therapy and immunotherapy", Advanced Drug Delivery Reviews 168: 158-180 May (Year: 2020).*

Doudna, J., "The promise and challenge of therapeutic genome editing", Nature, vol. 578, pp. 229-236, February (Year: 2020).*

Wan et al., "Material solutions for delivery of CRISPR/Cas-based genome editing tools: Current Status and future outlook", Materials Today vol. 26, pp. 40-66 June (Year: 2019).*

Chen et al., "Targeting genomic rearrangements in tumor cells through Cas9-mediated insertion of a suicide gene", Nature Biotechnology vol. 35, No. 6, pp. 543-553 June (Year: 2017).*

Gratz et al., Highly specific and efficient CRISPR/Cas9-catalyzed homology-directed repair in *Drosophila*. Genetics. Apr. 2014;196(4):961-71.

Jinek et al., RNA-programmed genome editing in human cells. Elife. Jan. 29, 2013;2:e00471, 9 pages.

Shen et al., Efficient genome modification by CRISPR-Cas9 nickase with minimal off-target effects. Nat Methods. Apr. 2014;11(4):399-402.

International Search Report for Application No. PCT/US2015/055002, dated May 2, 2016, 6 pages.

International Preliminary Report on Patentability for Application No. PCT/US2015/055002, dated Apr. 11, 2017, 10 pages.

Fischbach et al., Cell-based therapeutics: the next pillar of medicine. Sci Transl Med. Apr. 3, 2013;5(179):179ps7, 13 pages.

U.S. Appl. No. 15/518,105, filed Apr. 10, 2017, US 2018-0250424, Published.

* cited by examiner

*Types of donor template*

Template Binding Domain Partner

- Plasmid

- Linear dsDNA

*Position and length of a linear nucleic acid template system*

*Position and length of plasmid nucleic acid template systems*

Figure 5A

| RuvC I | BH | REC1 | REC2 | REC1 | RuvC II | HNH | RuvC III | PI |
|---|---|---|---|---|---|---|---|---|
| 1 | 60 | 94 180 | 308 | | 718 | 775 | 909 | 1099 1368 |

NUC lobe | REC lobe | NUC lobe

Figure 5B

| 32.74 | 34.44 | 26.84 | 27.07 | 29.41 | 27.62 | 26.44 | 26.64 |
|---|---|---|---|---|---|---|---|
| RuvC I | BH / REC1 | REC2 | REC1 | RuvC II | HNH | RuvC III | PI |
| 1 60 | 94 180 | 308 | | 718 775 | 909 | 1099 | 1368 |

33.47

500 ←—26.73%—→ 718

COMPOSITIONS AND METHODS FOR PROMOTING HOMOLOGY DIRECTED REPAIR

RELATED APPLICATIONS

This application is a divisional of U.S. patent application Ser. No. 15/518,105, filed on Apr. 10, 2017, which is a national stage application, filed under 35 U.S.C. § 371, of International Application No. PCT/US2015/055002, filed on Oct. 9, 2015, which claims the benefit of U.S. Provisional Patent Application No. 62/062,815, filed on Oct. 10, 2014, and to U.S. Provisional Patent Application No. 62/068,371, filed on Oct. 24, 2014. The entire contents of each of the foregoing applications is expressly incorporated herein by reference.

SEQUENCE LISTING

The instant application contains a Sequence Listing, which has been submitted electronically in ASCII format and is hereby incorporated by reference in its entirety. Said ASCII copy, created on Aug. 4, 2021, is named 126454_00204_ST25.txt and is 964,574 bytes in size.

BACKGROUND

The CRISPR (Clustered Regularly Interspaced Short Palindromic Repeats)/Cas (CRISPR-associated) system evolved in bacteria and archaea as an adaptive immune system to defend against viral attack. Upon exposure to a virus, short segments of viral DNA are integrated into the CRISPR locus. RNA is transcribed from a portion of the CRISPR locus that includes the viral sequence. That RNA, which contains sequence complimentary to the viral genome, mediates targeting of a Cas9 protein to the sequence in the viral genome. The Cas9 protein cleaves and thereby silences the viral target.

Recently, the CRISPR/Cas system has been adapted for genome editing in eukaryotic cells. The introduction of site-specific double strand breaks (DSBs) enables target nucleic acid alteration through homology-directed repair (HDR).

SUMMARY

This disclosure provides systems and methods for editing a genome, e.g., by correcting a mutation. Using the methods and compositions disclosed herein, a Cas9 fusion molecule or Cas9 system may be used to mediate a break or nick near a target position, e.g., a chromosome position, that one desires to edit. The cell then utilizes one of several repair pathways, e.g., HDR, to repair the break or nick. Provided herein is a Cas9 repair system comprising a Cas9 fusion molecule, a nucleic acid template system, and optionally, at least one gRNA molecule. While not being bound by theory, it is believed that by contacting a cell, or population of cells, with the Cas9 repair systems disclosed herein, the proximity of the template nucleic acid used by the cell to repair a Cas9-mediated cleavage event can be increased, and the frequency of use of a particular DNA repair pathway, e.g., HDR, can be modulated.

In one aspect, described herein is a Cas9 fusion molecule comprising a Cas9 molecule linked to a template binding domain.

In one embodiment, the template binding domain comprises a specific affinity for a template binding domain partner. In one embodiment, the template binding domain does not comprise substantial affinity for a nucleic acid from one or more of a human, a non-human animal, a mammal, a eukaryote, a plant, or a pathogen.

In one embodiment, the template binding domain is not a nuclease, a transcription factor, an antibody or other complementarity determining region (CDR)-based molecule, a protein that alters chromatin, a protein that binds chromatin, a protein that modifies DNA, a DNA methylase, a protein that cleaves DNA, a protein that unwinds DNA, or any combination thereof. In one embodiment, the nuclease is an endonuclease or an exonuclease. In one embodiment, the chromatin comprises a histone.

In one embodiment, the template binding domain does not comprise substantial affinity for a nucleic acid from a preselected species. In one embodiment, the preselected species is a human, a non-human animal, a mammal, a eukaryote, a plant, a pathogen, or any combination thereof. In one embodiment, the preselected species is human.

In one embodiment, the Cas9 molecule is covalently linked to the template binding domain. In another embodiment, the Cas9 molecule is non-covalently linked to the template binding domain.

In one embodiment, the template binding domain is linked to the N-terminus of the Cas9 molecule. In one embodiment, the template binding domain is covalently linked to the N-terminus of the Cas9 molecule. In another embodiment, the template binding domain is non-covalently linked to the N-terminus of the Cas9 molecule.

In one embodiment, the template binding domain is linked to the C-terminus of the Cas9 molecule. In one embodiment, the template binding domain is covalently linked to the C-terminus of the Cas9 molecule. In another embodiment, the template binding domain is non-covalently linked to the C-terminus of the Cas9 molecule.

In one embodiment, the Cas9 fusion molecule comprises at least two template binding domains.

In one embodiment, the template binding domain comprises a protein, a nucleic acid, or a small molecule. In one embodiment, the nucleic acid is a DNA or an RNA. In one embodiment, the template binding domain comprises a protein, wherein the protein comprises a DNA binding domain. In one embodiment, the protein comprises a repressor protein, or a fragment of a repressor protein. In one embodiment, the repressor protein, or the fragment of the repressor protein, is a TetR repressor, or a fragment of the TetR repressor; a LacI repressor, or a fragment of the LacI repressor; a Gal4 repressor, or a fragment of the Gal4 repressor; or a repressor protein C1, or a fragment of the repressor protein C1.

In one embodiment, the Cas9 fusion protein comprises a linker between the Cas9 molecule and the template binding domain. In one embodiment, the linker is sufficiently long to allow the Cas9 molecule to bind to a target nucleic acid and the template binding domain to bind to a template binding domain partner without steric interference. In one embodiment, the linker is at least 6, but no longer than 60 amino acids in length. In another embodiment, the linker is at least 18, but no longer than 180 nucleotides in length. In one embodiment, the linker is at least 10, 50, 100, 200, 500, 1000, 2000, 5000, or 10000 Angstroms in length. In one embodiment, the linker is no more than 10, 50, 100, 200, 500, 1000, 2000, 5000, or 10000 Angstroms in length. In one embodiment, the linker comprises a polypeptide. In one embodiment, the linker comprises serine, glycine, or glycine and serine. In one embodiment, the linker comprises a sequence of Table 2 or Table 3.

In yet another embodiment, the Cas9 molecule is a Cas9 molecule selected from Table 100. In one embodiment, the Cas9 molecule is a Cas9 molecule selected from Table 600. In one embodiment, the Cas9 molecule is not a wild-type Cas9 molecule.

In one embodiment, the Cas9 molecule is an eaCas9 molecule. In one embodiment, the eaCas9 molecule forms a double stranded break in a target nucleic acid. In one embodiment, the eaCas9 molecule comprises N-terminal RuvC-like domain cleavage activity and HNH-like domain cleavage activity. In another embodiment, the eaCas9 molecule forms a single stranded break in a target nucleic acid. In one embodiment, the eaCas9 molecule comprises HNH-like domain cleavage activity but has no, or no significant, N-terminal RuvC-like domain cleavage activity. In one embodiment, the eaCas9 molecule is an HNH-like domain nickase. In one embodiment, the eaCas9 molecule comprises a mutation at an amino acid position corresponding to amino acid position D10 of *Streptococcus pyogenes* Cas9. In yet another embodiment, the eaCas9 molecule comprises N-terminal RuvC-like domain cleavage activity but has no, or no significant, HNH-like domain cleavage activity. In one embodiment, the eaCas9 molecule is an N-terminal RuvC-like domain nickase. In one embodiment, the eaCas9 molecule comprises a mutation at an amino acid position corresponding to amino acid position H840 or N863 of *S. pyogenes* Cas9.

In another embodiment, the Cas9 molecule is an eiCas9 molecule. In some embodiments, the Cas9 molecule comprises a mutation, e.g., a point mutation, that causes the Cas9 molecule to be inactive, e.g., a mutation that eliminates the Cas9 molecule cleavage activity.

In one embodiment, the Cas9 molecule comprises a REC2 deletion, $REC1_{CT}$ deletion, or a $REC1_{SUB}$ deletion, or any combination thereof.

In one embodiment, the Cas9 molecule comprises an altered PI domain.

In another embodiment, the Cas9 molecule is less than about 1300 amino acids in length. In one embodiment, the Cas9 molecule is less than about 1200, 1100, 1000, 900, or 800 amino acids in length. In one embodiment, the Cas9 molecule is between about 800 to 1300, 900 to 1200, 900 to 1100, or 900 to 1000 amino acids in length.

In one embodiment, the Cas9 fusion molecule is substantially purified.

In another aspect, described herein is a Cas9 system comprising a Cas9 fusion molecule described herein, and a nucleic acid template system comprising a template binding domain partner and a template nucleic acid.

In one embodiment, the template binding domain of the Cas9 fusion molecule is bound to the template binding domain partner. In one embodiment, the template binding domain of the Cas9 fusion molecule is covalently bound to the template binding domain partner. In another embodiment, the template binding domain of the Cas9 fusion molecule is non-covalently bound to the template binding domain partner.

In one embodiment, the template binding domain partner is linked to the template nucleic acid. In one embodiment, the template binding domain partner is covalently linked to the template nucleic acid. In another embodiment, the template binding domain partner is non-covalently linked to the template nucleic acid.

In one embodiment, the template binding domain partner comprises a protein, a nucleic acid, or a small molecule. In one embodiment, the nucleic acid is a DNA or an RNA. In one embodiment, the template binding domain comprises a protein and the template binding domain partner comprises a protein.

In one embodiment, the template binding domain comprises a protein and the template binding domain partner comprises a nucleic acid. In one embodiment, the nucleic acid is a DNA. In one embodiment, the DNA is a double-stranded DNA or a single-stranded DNA. In one embodiment, the nucleic acid is an RNA.

In one embodiment, the template binding domain comprises a protein and the template binding domain partner comprises a small molecule.

In another embodiment, the template binding domain comprises a small molecule, and the template binding domain partner comprises a protein.

In one embodiment, the template binding domain comprises a small molecule, and the template binding domain partner comprises a small molecule.

In yet another embodiment, the template binding domain comprises a small molecule, and the template binding domain partner comprises a nucleic acid. In one embodiment, the template binding domain comprises a nucleic acid, and the template binding domain partner comprises a protein. In another embodiment, the template binding domain comprises a nucleic acid, and the template binding domain partner comprises a nucleic acid. In one embodiment, the template binding domain comprises a nucleic acid, and the template binding domain partner comprises a small molecule. In one embodiment, the nucleic acid is an RNA. In another embodiment, the nucleic acid is a DNA. In one embodiment, the DNA is a double-stranded DNA or a single-stranded DNA.

In one embodiment, the template binding domain partner is a DNA sequence recognized by a DNA binding protein. In one embodiment, the DNA sequence recognized by the DNA binding protein is selected from a Tet-O sequence, a Lac operon 01 sequence, a UAS sequence, or an Operator L and R sequence. In yet another embodiment, the template binding domain partner comprises a repressor-binding DNA sequence from a bacterial operon. In one embodiment, the protein comprises a TetR repressor, or a fragment of the TetR repressor, and the DNA comprises at least one Tet-O sequence. In one embodiment, the DNA comprises at least two, three, four, five, or six Tet-O sequences. In one embodiment, the DNA comprises a spacer sequence between the Tet-O sequences. In one embodiment, the spacer sequence is at least 17 nucleotides in length. In another embodiment, the spacer sequence is at least 16, 15, 14, 13, 12, 11, 10, 9, 8, 7, 6, 5, 4, 3, 2, or 1 nucleotides in length. In one embodiment, the DNA does not comprise a spacer sequence between the Tet-O sequences.

In one embodiment, the template binding domain partner comprises a protein that is not a nuclease, a transcription factor, an antibody or other CDR-based molecule, a protein that alters chromatin, a protein that binds chromatin, a protein that modifies DNA, a DNA methylase, a protein that cleaves DNA, a protein that unwinds DNA, or any combination thereof. In one embodiment, the nuclease is an endonuclease or an exonuclease. In one embodiment, the chromatin comprises a histone.

In one embodiment, the Cas9 system comprises at least one additional template binding domain and at least one additional template binding domain partner.

In one embodiment, the template binding domain partner comprises a linear nucleic acid. In another embodiment, the template binding domain partner comprises a nucleic acid sequence located on a circular nucleic acid.

In one embodiment, the template binding domain partner comprises a double stranded nucleic acid sequence. In one embodiment, the template binding domain partner comprises a single stranded nucleic acid sequence.

In one embodiment, the template nucleic acid comprises a double stranded nucleic acid sequence or a single stranded nucleic acid sequence.

In one embodiment, the nucleic acid template system comprises a double stranded nucleic acid sequence or a single stranded nucleic acid sequence.

In one embodiment, the template nucleic acid comprises a linear nucleic acid. In another embodiment, the template nucleic acid is a nucleic acid located on a circular nucleic acid.

In one embodiment, the template binding domain partner comprises a double stranded nucleic acid; and the template nucleic acid comprises a double stranded nucleic acid.

In one embodiment, the template binding domain partner comprises a double stranded nucleic acid; and the template nucleic acid comprises a single stranded nucleic acid.

In one embodiment, the nucleic acid template system is a circular nucleic acid. In another embodiment, the nucleic acid template system is a linear nucleic acid.

In one embodiment, the template binding domain partner comprises a single stranded nucleic acid; and the template nucleic acid comprises a single stranded nucleic acid.

In another embodiment, the template binding domain partner comprises a single stranded nucleic acid; and the template nucleic acid comprises a double stranded nucleic acid.

In one embodiment, the nucleic acid template system is a single stranded nucleic acid, and the template binding domain partner is 5' of the template nucleic acid. In another embodiment, the nucleic acid template system is a single stranded nucleic acid, and the template binding domain partner is 3' of the template nucleic acid.

In one embodiment, the nucleic acid template system is a double stranded nucleic acid, and the template binding domain partner is 5' of the template nucleic acid. In another embodiment, the nucleic acid template system is a double stranded nucleic acid, and the template binding domain partner is 3' of the template nucleic acid.

In one embodiment, the template nucleic acid comprises about 50-500 nucleotides of homology with a target nucleic acid. In one embodiment, the template nucleic acid comprises about 100-200 nucleotides of homology with a target nucleic acid. In one embodiment, the template nucleic acid comprises about 500-2000 nucleotides of homology with a target nucleic acid.

In one embodiment, the template nucleic acid comprises a human nucleic acid sequence. In one embodiment, the template nucleic acid comprises a wild-type human nucleic acid sequence.

In yet another embodiment, the Cas9 system further comprises at least one additional template binding domain partner.

In one embodiment, the template nucleic acid lacks repeated elements. In one embodiment, the repeated element is an Alu element or a LINE element.

In one embodiment, the Cas9 system further comprises a gRNA. In one embodiment, the gRNA comprises a targeting domain, first and second complementary domains, and a proximal domain. In one embodiment, the gRNA is a chimeric gRNA.

In one embodiment, the Cas9 system further comprises at least one additional Cas9 molecule. In some embodiment, the Cas9 molecule is an eaCas9 molecule. In some embodiments, the Cas9 molecule is an eiCas9 molecule. In one embodiment, Cas9 system comprises a Cas9 fusion molecule, comprising an eiCas9 molecule linked to a template binding domain, and a Cas9 molecule. In one embodiment, Cas9 system comprises a Cas9 fusion molecule, comprising an eiCas9 molecule linked to a template binding domain, and an eaCas9 molecule.

In another aspect, described herein is a cell, or a population of cells, comprising a Cas9 system described herein.

In yet another aspect, described herein is a cell, or a population of cells, comprising a Cas9 fusion molecule described herein.

In another aspect, described herein is a nucleic acid encoding a Cas9 fusion molecule described herein. In yet another aspect, described herein is a vector comprising said nucleic acid. In one embodiment, the vector is an AAV vector. In one aspect, described herein is a cell, or a population of cells, comprising said nucleic acid.

In another aspect, described herein is a method of altering a nucleic acid at a target position in a cell, or a population of cells, the method comprising contacting the cell with the Cas9 system described herein, wherein the gRNA molecule and Cas9 fusion molecule interact with the nucleic acid, resulting in a cleavage event, wherein the cleavage event is repaired by at least one DNA repair pathway, and wherein the sequence of the nucleic acid after the cleavage event is different than the sequence of the nucleic acid prior to the cleavage event, thereby altering the nucleic acid at the target position in the cell, or in the population of cells.

In one embodiment, the method, further comprises contacting the cell, or the population of cells, with a second gRNA molecule, wherein the second gRNA molecule and the Cas9 fusion molecule interact with the nucleic acid, resulting in a second cleavage event.

In one embodiment, the at least one DNA repair pathway is selected from the group consisting of resection, mismatch repair (MMR), nucleotide excision repair (NER), base excision repair (BER), canonical non-homologous end joining (canonical NHEJ), alternative non-homologous end joining (ALT-NHEJ), canonical homology directed-repair (canonical HDR), alternative homology directed repair (ALT-HDR), microhomology-mediated end joining (MMEJ), Blunt End Joining, Synthesis Dependent Microhomology Mediated End Joining, single strand annealing (SSA), Holliday junction model or double strand break repair (DSBR), synthesis-dependent strand annealing (SDSA), single strand break repair (SSBR), translesion synthesis repair (TLS), and inter-strand crosslink repair (ICL), and DNA/RNA processing.

In one embodiment, the at least one DNA repair pathway is canonical homology directed-repair (canonical HDR) or alternative homology directed repair (ALT-HDR).

In one embodiment, the cleavage event comprises one or more single strand breaks, one or more double strand breaks, or a combination of single strand breaks and double strand breaks.

In one embodiment, the gRNA molecule positions one cleavage event on each strand of the nucleic acid.

In yet another embodiment, the gRNA molecule positions the cleavage event on a strand of the nucleic acid that binds to the gRNA molecule.

In one embodiment, the second gRNA molecule positions the second cleavage event on a strand of the nucleic acid that binds to the second gRNA molecule.

In one embodiment, the Cas9 fusion molecule makes a single strand break in the nucleic acid. In another embodiment, the Cas9 fusion molecule makes a double strand break in the nucleic acid. In one embodiment, the single strand break is made in the strand of the nucleic acid to which a targeting domain of the gRNA molecule is complementary. In another embodiment, the single strand break is made in the strand of the nucleic acid other than the strand to which a targeting domain of the gRNA is complementary.

In one embodiment, the target position is in an HBB gene.

In one embodiment, the cell, or the population of cells, is a eukaryotic cell, or a population of eukaryotic cells. In one embodiment, the cell, or the population of cells, is a plant cell, or a population of plant cells. In one embodiment, the plant cell, or the population of plant cells, is a monocot plant cell, a dicot plant cell, a population of monocot plant cells, or a population of dicot plant cells.

In another embodiment, the cell, or the population of cells, is a mammalian cell, or a population of mammalian cells. In one embodiment, the cell, or the population of cells, is a human cell, or a population of human cells.

In one embodiment, the cell, or the population of cells, is a vertebrate, mammalian, rodent, goat, pig, bird, chicken, turkey, cow, horse, sheep, fish, primate, or human cell or population of cells.

In one embodiment, the cell, or the population of cells, is a somatic cell, a germ cell, or a prenatal cell or population of cells.

In another embodiment, the cell, or the population of cells, is a zygotic cell, a blastocyst, an embryonic cell, a stem cell, a mitotically competent cell, a meiotically competent cell or population of cells.

In one embodiment, the cell, or the population of cells, is a T cell, a CD8+ T cell, a CD8+ naïve T cell, a central memory T cell, an effector memory T cell, a CD4+ T cell, a stem cell memory T cell, a helper T cell, a regulatory T cell, a cytotoxic T cell, a natural killer T cell, a Hematopoietic Stem Cell, a long term hematopoietic stem cell, a short term hematopoietic stem cell, a multipotent progenitor cell, a lineage restricted progenitor cell, a lymphoid progenitor cell, a myeloid progenitor cell, a common myeloid progenitor cell, an erythroid progenitor cell, a megakaryocyte erythroid progenitor cell, a monocytic precursor cell, an endocrine precursor cell, an exocrine cell, a fibroblast, a retinal cell, a photoreceptor cell, a rod cell, a cone cell, a retinal pigmented epithelium cell, a trabecular meshwork cell, a cochlear hair cell, an outer hair cell, an inner hair cell, a pulmonary epithelial cell, a bronchial epithelial cell, an alveolar epithelial cell, a pulmonary epithelial progenitor cell, a striated muscle cell, a cardiac muscle cell, a muscle satellite cell, a myocyte, a neuron, a neuronal stem cell, a mesenchymal stem cell, an induced pluripotent stem (iPS) cell, an embryonic stem cell, a monocyte, a megakaryocyte, a neutrophil, an eosinophil, a basophil, a mast cell, a reticulocyte, a B cell, e.g. a progenitor B cell, a Pre B cell, a Pro B cell, a memory B cell, a plasma B cell, a gastrointestinal epithelial cell, a biliary epithelial cell, a pancreatic ductal epithelial cell, an intestinal stem cell, a hepatocyte, a liver stellate cell, a Kupffer cell, an osteoblast, an osteoclast, an adipocyte, a preadipocyte, a pancreatic precursor cell, a pancreatic islet cell, a pancreatic beta cell, a pancreatic alpha cell, a pancreatic delta cell, a pancreatic exocrine cell, a Schwann cell, or an oligodendrocyte, or population of such cells.

In one embodiment, the cell, or population of cells, is from a subject suffering from a disease or disorder.

In one embodiment, the disease is a blood disease, an immune disease, a neurological disease, a cancer, an infectious disease, a genetic disease, a disorder caused by aberrant mtDNA, a metabolic disease, a disorder caused by aberrant cell cycle, a disorder caused by aberrant angiogenesis, a disorder cause by aberrant DNA damage repair, or a pain disorder.

In one embodiment, the cell, or population of cells, is from a subject having at least one mutation at the target position.

In one embodiment, the method further comprises isolating the cell, or population of cells, from the subject prior to contacting the cell, or population of cells, with the Cas9 system described herein.

In one embodiment, the method further comprises introducing the cell, or the population of cells, into a subject after contacting the cell, or the population of cells, with the Cas9 system described herein.

In one embodiment, the contacting the cell, or the population of cells, with the Cas9 system described herein is performed ex vivo. In another embodiment, the contacting the cell, or the population of cells, with the Cas9 system described herein is performed in vivo. In one embodiment, the contacting the cell, or the population of cells, with the Cas9 system described herein is performed in vitro.

In one embodiment, the method further comprises sequencing the nucleic acid, or a portion of the nucleic acid, prior to contacting the cell, or the population of cells, with the Cas9 system described herein.

In one embodiment, the method further comprises sequencing the nucleic acid, or a portion of the nucleic acid, after the cleavage event.

In one embodiment, the cell, or the population of cells, is contacted with the gRNA molecule and the Cas9 fusion molecule as a pre-formed complex.

In one aspect, described herein is a cell, or a population of cells, altered by the methods described herein. In another aspect, described herein is a pharmaceutical composition comprising said cell, or said population of cells.

In yet another aspect, described herein is a pharmaceutical composition comprising a Cas9 system described herein.

In one aspect, described herein is a method of treating a subject comprising administering to the subject the cell, or the population of cells, altered by the methods described herein, or a pharmaceutical composition comprising said cell, or said population of cells.

In another aspect, described herein is a method of treating a subject suffering from a disease or disorder, the method comprising contacting a cell, or a population of cells, from the subject with the Cas9 system described herein, wherein the gRNA molecule and the Cas9 fusion molecule interact with a nucleic acid at a target position, resulting in a cleavage event, wherein the cleavage event is repaired by at least one DNA repair pathway, and wherein the sequence of the nucleic acid after the cleavage event is different than the sequence of the nucleic acid prior to the cleavage event, thereby treating the subject suffering from the disease or disorder.

In one embodiment, the method further comprises contacting the cell from the subject with a second gRNA molecule, wherein the second gRNA molecule and the Cas9 fusion molecule interact with the nucleic acid, resulting in a second cleavage event.

In one embodiment, the contacting the cell is performed ex vivo. In another embodiment, the contacting the cell is performed in vivo.

In certain aspects, the present disclosure provides a cell comprising:
 a Cas9 molecule and a template binding domain, wherein optionally the Cas9 molecule is linked to the template binding domain;

wherein said template binding domain comprises specific affinity for a template binding domain partner and lacks substantial affinity for:
- (i) the endogenous nucleic acid of said cell;
- (ii) the endogenous chromosomal nucleic acid of said cell; or
- (iii) the endogenous organellar nucleic acid, e.g., mitochondrial, chloroplast, or both, of said cell.

In certain aspects, the present disclosure also provides a cell comprising:
- (a) a Cas9 molecule and a template binding domain; wherein optionally the Cas9 molecule is linked to the template binding domain; and
- (b) a gRNA molecule having a targeting domain complementary with a target sequence;

wherein said template binding domain comprises specific affinity for a template binding domain partner and lacks substantial affinity for a nucleic acid sequence within 100, 500, 1000, 2000, 5,000, or 10,000 nucleotides of said target sequence.

In certain aspects, the present disclosure also provides a kit comprising packaging and at least three of
- (a) a Cas9 fusion molecule,
- (b) a template binding domain,
- (c) a template binding domain partner, and
- (d) a template nucleic acid.

In the kit, in some embodiments, (a) and (b) form part of a single composition; (a) and (c) form part of a single composition; (a) and (d) form part of a single composition; (b) and (c) form part of a single composition; (b) and (d) form part of a single composition; (c) and (d) form part of a single composition; (a), (b), and (c) form part of a single composition; (a), (b), and (d) form part of a single composition; (a), (c), and (d) form part of a single composition; (b), (c), and (d) form part of a single composition; or (a), (b), (c), and (d) form part of a single composition.

In certain aspects, the present disclosure also provides a reaction mixture comprising the cell and a solution.

In certain aspects, the present disclosure also provides a reaction mixture wherein the solution is a cell growth medium.

In certain aspects, the present disclosure provides a method of altering the structure of a cell, e.g., altering the sequence, of a target nucleic acid of the cell, comprising contacting the cell with the Cas9 system as described herein under conditions that allow for alteration of the structure of the cell, thereby altering the structure of a cell, e.g., altering the sequence of a target nucleic acid.

In some embodiments the method, comprises bringing a template nucleic acid in proximity with a target nucleic acid in a cell, e.g., sufficient proximity that the efficiency of altering the cell, e.g., a target nucleic acid of the cell, is increased over the level seen with a non bound template nucleic acid.

In some embodiments, the target nucleic acid is cleaved at a position that is:
- i) at a target position;
- ii) away from a target position;
- iii) within 200 nucleotides of the target position;
- iv) at least 10 nucleotides away from the target position; or
- v) 10 to 200 nucleotides away from the target position.

In some embodiments, the target nucleic acid is cleaved at two positions that are:
- within 55 nucleotides of one another;
- at least 25 nucleotides apart; or within 25-55 nucleotides of one another.

Other features and advantages of the invention will be apparent from the detailed description, drawings, and from the claims.

The homology regions to the left are shown as solid lines and the homology regions to the right are shown as dotted lines. The central row shows embodiments where the template nucleic acid has the majority of the homology on the right side of the cut, e.g., approximately 150-200 bp or nucleotides of homology. The bottom row shows embodiments where the template nucleic acid has the majority of the homology on the left side of the cut, e.g., approximately 150-200 bp or nucleotides of homology. In all the rows, the template binding domain partner can be placed at either end of the nucleic acid template system; in the left column the template binding domain partner is placed at the right of the nucleic acid template system, and in the right column the template binding domain partner is placed at the left of the nucleic acid template system.

Figure 4:
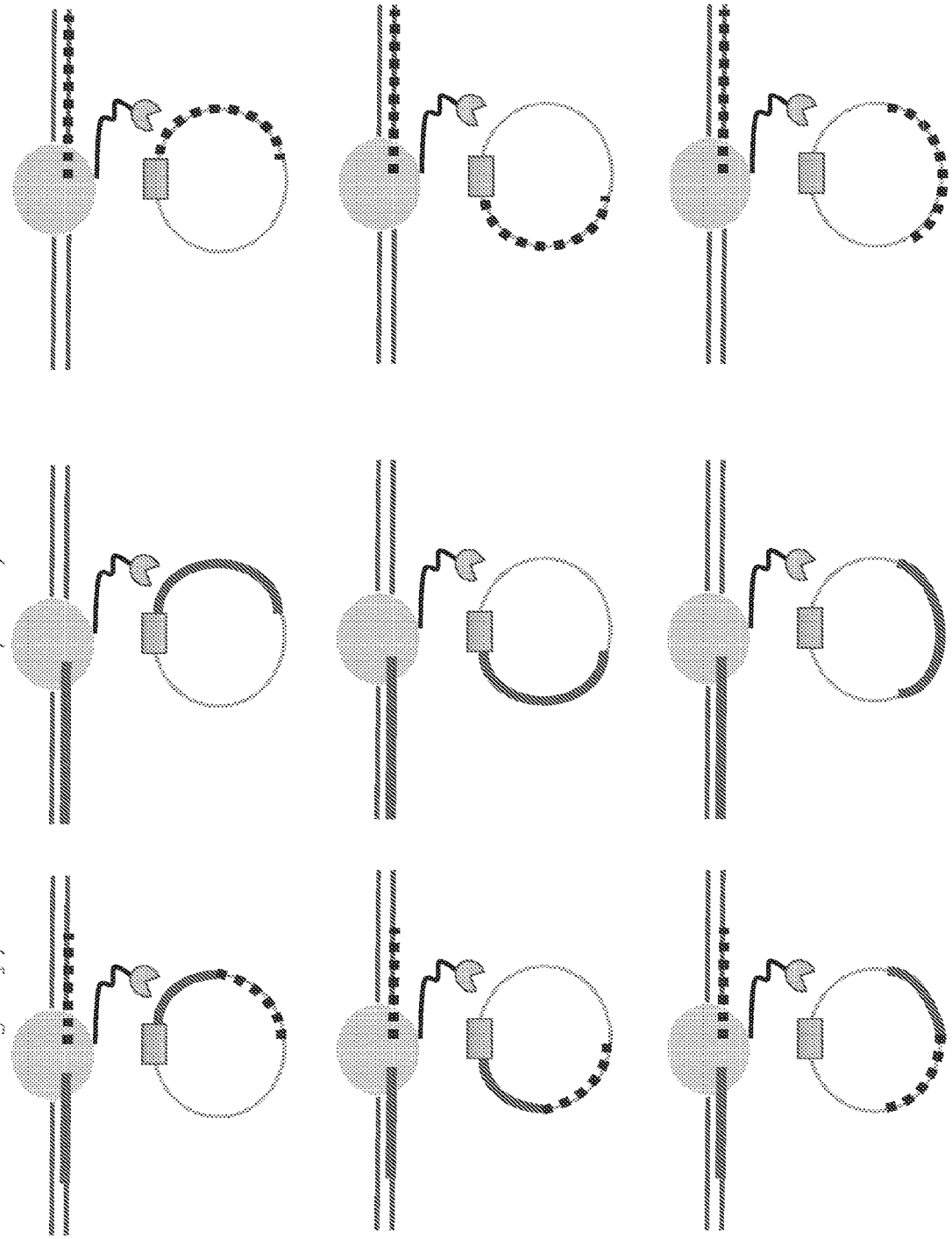

FIG. 4 depicts exemplary arrangements of circular nucleic acid template systems. The target nucleic acid (a long double stranded DNA segment like a gene or chromosome) is depicted as a double stranded shaded line with a break. The regions of the target nucleic acid that are homologous to a template nucleic acid are shown as thick solid or dotted lines. The Cas9 molecule is depicted as a shaded circle positioned over the break, and the template binding domain extends from the Cas9 molecule. The nucleic acid template systems are shown below the target nucleic acids, with the template binding domain partner is shown as a shaded box and the template nucleic acid as a dotted or solid line. In this figure, the circular nucleic acid template systems are double stranded DNA, but it is understood that the disclosure also contemplates circular molecules that are partly or whole single stranded. The top row shows embodiments where the template nucleic acid has a homology region to the right of the template binding domain partner. The center row shows embodiments where the template nucleic acid has a homology region to the left of the template binding domain partner. The bottom row shows embodiments where the template nucleic acid has a homology region on the opposite side of the circular DNA molecule from the template binding domain partner. In all nine arrangements, the homology region on the template nucleic acid can corresponds to a region on the target nucleic acid, where a solid line is homologous with a solid line and a dotted line is homologous with a dotted line. In the left column, the template nucleic acid has homology to the target nucleic acid on either side of the break. In the central column, the template nucleic acid has homology to the target nucleic acid on the left side of the break. In the right column, the template nucleic acid has homology to the target nucleic acid on the right side of the break. The homology region can be, e.g., 500 to 2000 bp.

FIGS. 5A and 5B are schematic representations of the domain organization of S. pyogenes Cas9. FIG. 5A shows the organization of the Cas9 domains, including amino acid positions, in reference to the two lobes of Cas9 (recognition (REC) and nuclease (NUC) lobes). FIG. 5B shows the percent homology of each domain across 83 Cas9 orthologs.

Figure 6:
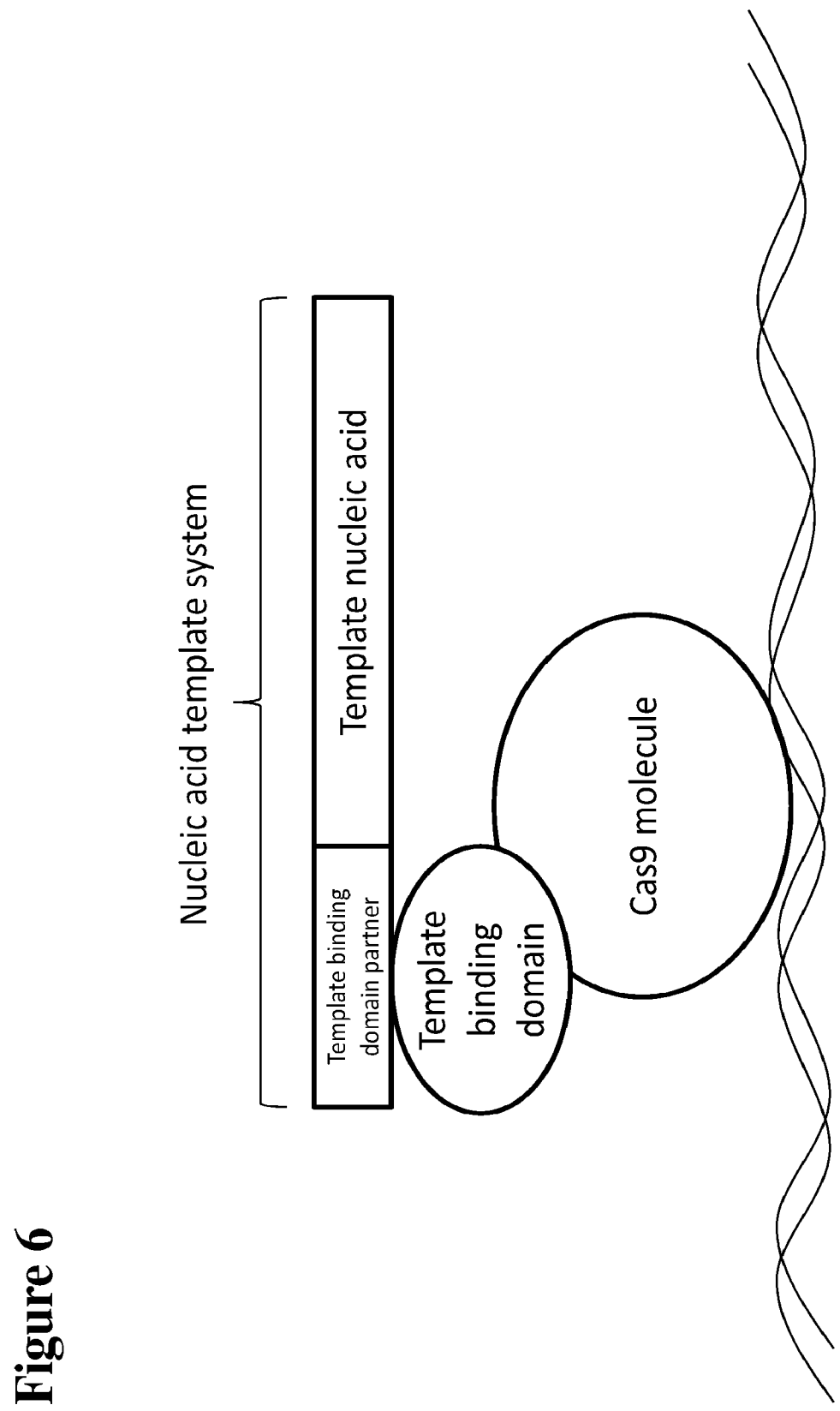

FIG. 6 is a schematic drawing of a Cas9 fusion molecule, comprising a Cas9 molecule fused to a template binding domain, bound to a target nucleic acid, and complexed with a nucleic acid template system comprising a template binding domain partner and a template nucleic acid.

Figure 7:
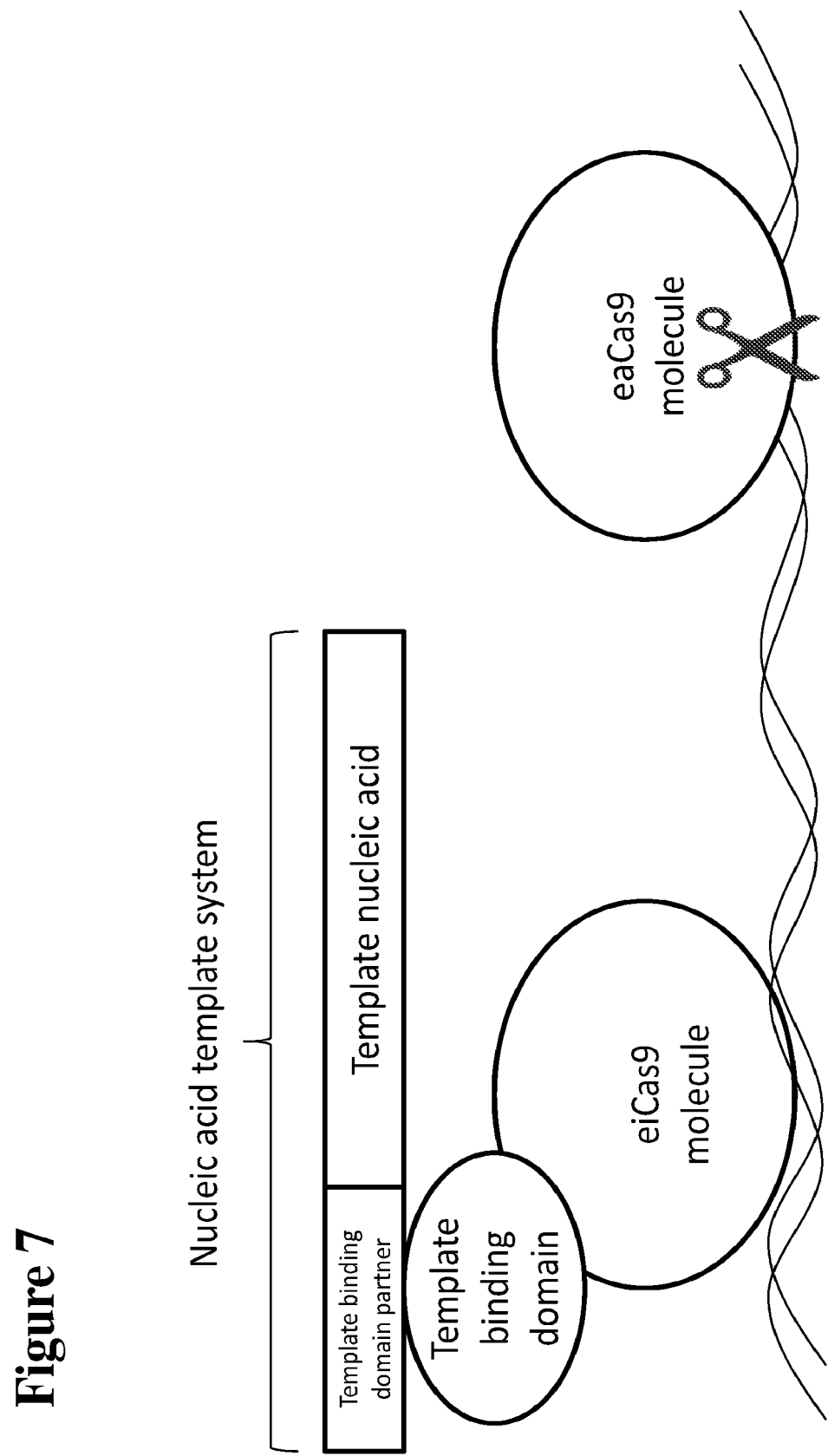

FIG. 7 is a schematic drawing of a Cas9 system comprising an eaCas9 molecule bound to a target nucleic acid, and a Cas9 fusion molecule, comprising an eiCas9 molecule fused to a template binding domain, bound to a target nucleic acid, and complexed with a nucleic acid template system comprising a template binding domain partner and a template nucleic acid. The Cas9 fusion molecule positions the nucleic acid template system in close proximity to the eaCas9 molecule.

Figure 8A:
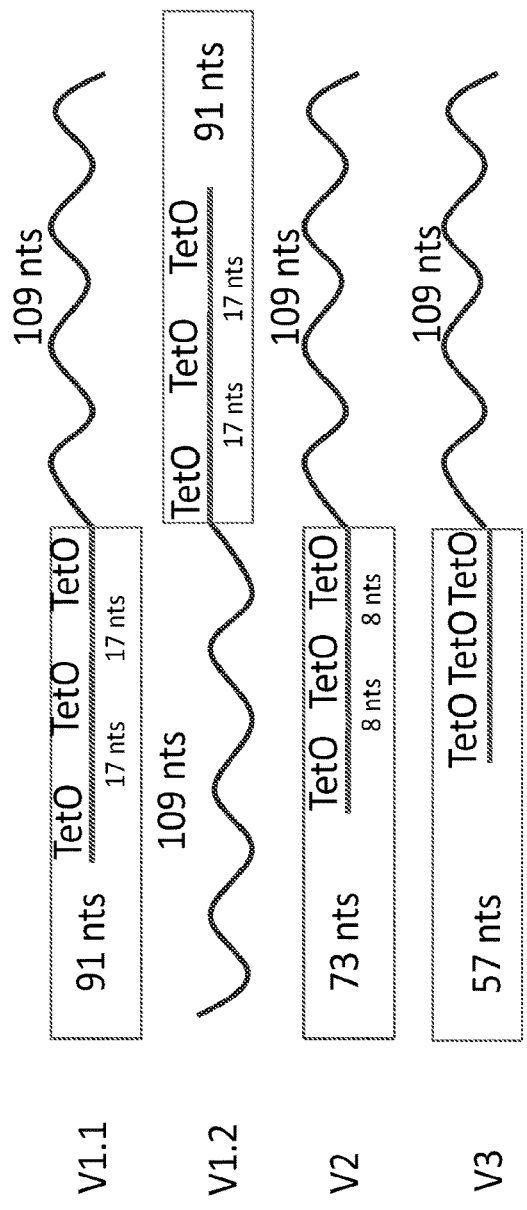

FIG. 8A illustrates four exemplary ssDNA nucleic acid template systems comprising a template binding domain partner, comprising three Tet Operator sequences, and a template nucleic acid. V1.1 is an exemplary ssDNA nucleic acid template system comprising a template binding domain partner, comprising three Tet Operator sequences separated by two 17 nucleotide spacers, N terminal of a 109 nucleotide template nucleic acid. V1.2 is an exemplary ssDNA nucleic acid template system comprising a template binding domain partner, comprising three Tet Operator sequences separated by two 17 nucleotide spacers, C terminal of a 109 nucleotide template nucleic acid. V2 is an exemplary ssDNA nucleic acid template system comprising a template binding domain partner, comprising three Tet Operator sequences separated by two 8 nucleotide spacers, N terminal of a 109 nucleotide template nucleic acid. V3 is an exemplary ssDNA nucleic acid template system comprising a template binding domain partner, comprising three Tet Operator sequences adjacent to one another without intervening spacers, N terminal of a 109 nucleotide template nucleic acid.

Figure 8B:
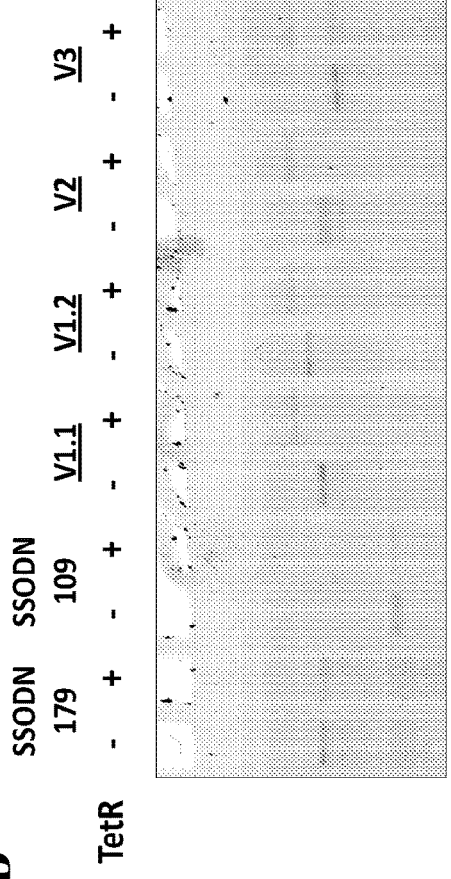

FIG. 8B shows Tet Repressor protein binding activity for four exemplary ssDNA nucleic acid template systems comprising a template binding domain partner, comprising three Tet Operator sequences, and a template nucleic acid (i.e., V1.1, V1.2, V2, and V3) and two control DNA templates (i.e., ssODN 179, and ssODN109. An electrophoretic mobility shift assay using a 10% polyacrylamide gel was performed using 500 nM of recombinant Tet Repressor protein 50 nM of ssDNA nucleic acid template system or control DNA template.

Figure 9:
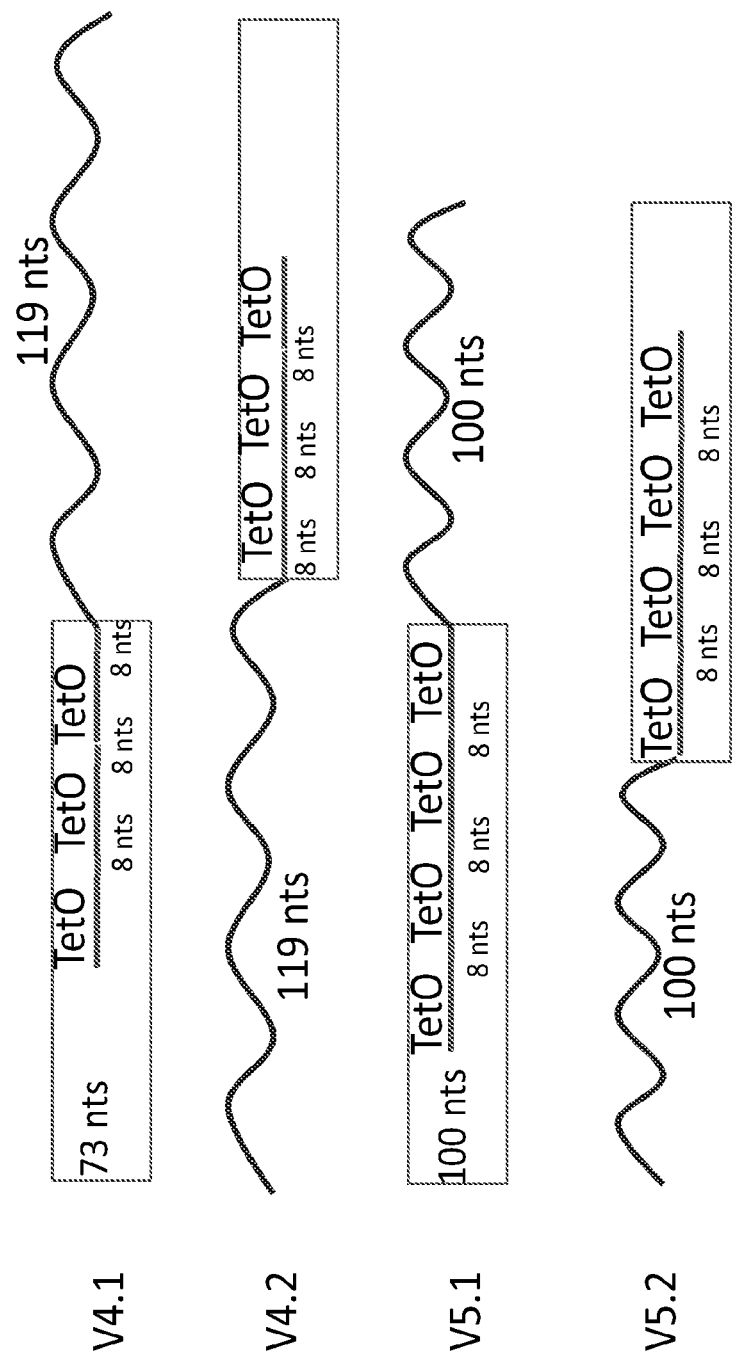

FIG. 9 illustrates four exemplary ssDNA nucleic acid template systems comprising a template binding domain partner, comprising three or four Tet Operator sequences, and a template nucleic acid. V4.1 is an exemplary ssDNA nucleic acid template system comprising a template binding domain partner, comprising three Tet Operator sequences separated by three 8 nucleotide spacers, N terminal of a 119 nucleotide template nucleic acid. V4.2 is an exemplary ssDNA nucleic acid template system comprising a template binding domain partner, comprising three Tet Operator sequences separated by three 8 nucleotide spacers, C terminal of a 119 nucleotide template nucleic acid. V5.1 is an exemplary ssDNA nucleic acid template system comprising a template binding domain partner, comprising four Tet Operator sequences separated by three 8 nucleotide spacers, N terminal of a 100 nucleotide template nucleic acid. V5.2 is an exemplary ssDNA nucleic acid template system comprising a template binding domain partner, comprising four Tet Operator sequences separated by three 8 nucleotide spacers, C terminal of a 100 nucleotide template nucleic acid.

DETAILED DESCRIPTION

Definitions

"Amino acids" as used herein encompasses the canonical amino acids as well as analogs thereof.

"Amino acid residues that flank a deletion", as that phrase is used herein, refers to the amino acid residue that immediately precedes the deletion and the amino acid residue that immediately follows the deletion. By way of example, in a sequence $_{CT}1$-$_{CT}2$-$_{CT}3$-$_{CT}7$-$_{CT}8$-$_{CT}9$, wherein $_{CT}4$-$_{CT}5$-$_{CT}6$ is deleted, the flanking amino acid residues are, $_{CT}3$ and $_{CT}7$.

"Cas9 core domain", as that term is used herein, refers to a polypeptide that does not include a functional PI domain, e.g., a polypeptide not having an endogenous PI domain, e.g., wherein the endogenous PI domain is deleted (deleted, as used in this context, refers merely to a sequence difference or the absence of amino acid residues and implies no process or origin limitation), or generally, a Cas9 molecule lacking a PI domain. In an embodiment, a Cas9 core domain comprises a REC1 domain, a REC2 domain, a BH domain, a RuvC domain, and an HNH domain. A Cas9 core domain, together with an altered PI domain, comprises a functional Cas9 molecule.

"Cas9 fusion molecule", "Cas9 fusion protein", or "Cas9 fusion", as used herein, refers to a chimeric protein comprising a Cas9 molecule, e.g., Cas9 protein or Cas9 polypeptide, or a fragment thereof, linked to a template binding domain. In some embodiments, the template binding domain is a protein or polypeptide. In some embodiments, the template binding domain is a nucleic acid, e.g., DNA or RNA. In some embodiments, the template binding domain is a small molecule. In some embodiments, the Cas9 fusion molecule comprises a Cas9 molecule covalently linked to the template binding domain. For example, the Cas9 fusion protein may be a chimeric protein comprising one or more Cas9 protein domains and a DNA binding domain from a protein disclosed herein. In some embodiments, the Cas9 fusion molecule comprises a Cas9 molecule noncovalently linked to the template binding domain.

In an embodiment, a species X Cas9 core domain has at least 20, 30, 40, 50, 60, 70, 80, 81, 82, 83, 84, 85, 86, 87, 88, 89, 90, 91, 92, 93, 94, 95, 96, 97, 98, 99, or 100% homology with the corresponding sequence of a reference sequence, e.g., a naturally occurring species X Cas9 core domain, e.g., from a Cas9 core domain from Table 100. In an embodiment, each of a REC1 domain, a REC2 domain, a BH domain, a RuvC domain, and/or an HNH domain of a species X Cas9 core domain has, independently, at least 20, 30, 40, 50, 60, 70, 80, 81, 82, 83, 84, 85, 86, 87, 88, 89, 90, 91, 92, 93, 94, 95, 96, 97, 98, 99, or 100% homology with the corresponding sequence of a reference sequence, e.g., a naturally occurring species X Cas9 core domain, e.g., from a Cas9 core domain from Table 100.

"Cas9 molecule" or "Cas9 polypeptide", as that term is used herein, refers to a polypeptide that can bind (1) a PAM (a protospacer adjacent motif) in a nucleic acid, and (2) a guide RNA (gRNA) molecule. In an embodiment, in concert with the gRNA molecule, a Cas9 molecule or Cas9 polypeptide can localize to a site which comprises a target domain.

Cas9 may be a nuclease (an enzyme that cleaves both strands of a double-stranded nucleic acid), a nickase (an enzyme that cleaves one strand of a double-stranded nucleic acid), or an enzymatically inactive (or dead) molecule. A Cas9 molecule having nuclease or nickase activity is referred to as an enzymatically active Cas9 molecule (an eaCas9 molecule). A Cas9 molecule lacking the ability to cleave target nucleic acid is referred to as an enzymatically inactive Cas9 molecule (an eiCas9 molecule). A Cas9 molecule can have the amino acid sequence of a naturally occurring Cas9 molecule or can be an altered, engineered or modified Cas9 molecule, which differs by at least one amino acid residue, from a reference sequence, e.g., the most similar naturally occurring Cas9 molecule, e.g., a Cas9 molecule from Table 100. (The terms altered, engineered or modified, as used in this context, refers merely to a difference from a reference or naturally occurring sequence, and impose no specific process or origin limitations.) For example, an altered, engineered or modified Cas9 molecule can comprise one or more point mutations which alter (e.g., increase, decrease and/or eliminate), one or more Cas9 molecule activities, e.g., a nuclease activity.

In an embodiment, a Cas9 molecule meets one or both of the following criteria:
it has at least 20, 30, 40, 50, 55, 60, 65, 70, 75, 80, 81, 82, 83, 84, 85, 86, 87, 88, 89, 90, 91, 92, 93, 94, 95, 96, 97, 98, 99, or 100% homology with, or
it differs by no more than 1, 2, 3, 4, 5, 6, 7, 8, 9, 10, 11, 12, 13, 14, 15, 16, 17, 18, 19, 20, 25, 30, 35, 40, 35, 50, 55, 60, 65, 70, 75, 80, 85, 90, 95, 100, 150, 200, 250, 300, 350 or 400, amino acid residues from, the amino acid sequence of a reference sequences, e.g., naturally occurring Cas9 molecule, e.g., a Cas9 molecule described in Table 100 herein.

In one embodiment, the Cas9 molecule may be a Cas9 deletion, e.g., the Cas9 may comprise a deletion in one or more of the following domains: a REC2, $REC1_{CT}$, or $REC1_{SUB}$ domain. Except for any REC deletion, a Cas9 molecule meets one or both of the following criteria:
it has at least 20, 30, 40, 50, 55, 60, 65, 70, 75, 80, 81, 82, 83, 84, 85, 86, 87, 88, 89, 90, 91, 92, 93, 94, 95, 96, 97, 98, 99, or 100% homology with, or
it differs by no more than 1, 2, 3, 4, 5, 6, 7, 8, 9, 10, 11, 12, 13, 14, 15, 16, 17, 18, 19, 20, 25, 30, 35, 40, 35, 50, 55, 60, 65, 70, 75, 80, 85, 90, 95, 100, 150, 200, 250, 300, 350 or 400, amino acid residues from, the amino acid sequence of a reference sequences, e.g., naturally occurring Cas9 molecule, e.g., a Cas9 molecule described in Table 100 herein. Homology except for any REC deletion is determined as follows: a sequence having a deletion is altered by replacing the deleted sequence with the corresponding sequence from the reference sequence, and the altered sequence is compared with the reference sequence.

In another embodiment, the Cas9 molecule may be a Cas9 variant, e.g., the Cas9 may comprise an altered PI domain, or other modified amino acid sequence, or the Cas9 may comprise a linker. In an alternate embodiment, except for an altered PI domain or other modified amino acid sequence, a Cas9 molecule meets one or both of the following criteria:
it has at least 20, 30, 40, 50, 55, 60, 65, 70, 75, 80, 81, 82, 83, 84, 85, 86, 87, 88, 89, 90, 91, 92, 93, 94, 95, 96, 97, 98, 99, or 100% homology with, or
it differs by no more than 1, 2, 3, 4, 5, 6, 7, 8, 9, 10, 11, 12, 13, 14, 15, 16, 17, 18, 19, 20, 25, 30, 35, 40, 35, 50, 55, 60, 65, 70, 75, 80, 85, 90, 95, 100, 150, 200, 250, 300, 350 or 400, amino acid residues from, the amino acid sequence of a reference sequences, e.g., naturally occurring Cas9 molecule, e.g., a Cas9 molecule described in Table 100 herein. Homology except for an altered PI domain, or other modified amino acid sequence is determined as follows: a sequence having an altered PI domain (or other modified amino acid sequence) is altered by restoring the altered PI domain (or other modified amino acid sequence) to the naturally occurring PI domain (or other naturally occurring sequence) from the reference sequence, and the thus altered sequence is compared with the reference sequence.

In an alternate embodiment, except for a linker, a Cas9 molecule meets one or both of the following criteria:
it has at least 20, 30, 40, 50, 55, 60, 65, 70, 75, 80, 81, 82, 83, 84, 85, 86, 87, 88, 89, 90, 91, 92, 93, 94, 95, 96, 97, 98, 99, or 100% homology with, or it differs by no more than 1, 2, 3, 4, 5, 6, 7, 8, 9, 10, 11, 12, 13, 14, 15, 16, 17, 18, 19, 20, 25, 30, 35, 40, 35, 50, 55, 60, 65, 70, 75, 80, 85, 90, 95, 100, 150, 200, 250, 300, 350 or 400, amino acid residues from, the amino acid sequence of a reference sequences, e.g., naturally occurring Cas9 molecule, e.g., a Cas9 molecule described in Table 100 herein. Homology except for a linker is determined as follows: a sequence having a linker is altered by omitting the linker sequence, and the thus altered sequence is compared with the reference sequence.

In another embodiment, each domain of the Cas9 molecule (e.g., the domains named in FIG. 5 or elsewhere herein), including any remaining portion of a REC2, REC1$_{CT}$, or REC1$_{SUB}$ domain having a deletion or an unaltered portion of a PI domain, will, independently have:

at least 20, 30, 40, 50, 55, 60, 65, 70, 75, 80, 81, 82, 83, 84, 85, 86, 87, 88, 89, 90, 91, 92, 93, 94, 95, 96, 97, 98, 99, or 100% homology with such a domain described herein, e.g., in a species of Table 100. In an embodiment at least 1, 2, 3, 4, 5, of 6 domains will have, independently, at least 50, 60, 70, 80, 81, 82, 83, 84, 85, 86, 87, 88, 89, 90, 91, 92, 93, 94, 95, 96, 97, 98, 99, or 100% homology with a corresponding domain, while any remaining domains will be absent, or have less homology to their corresponding naturally occurring domains.

"PI domain", as that term is used herein, refers to the region of a Cas9 molecule that interacts with the PAM sequence of a target nucleic acid.

"Altered PI domain", as that term is used herein, refers to a PI domain other than the native or endogenous PI domain associated with the naturally occurring Cas9 molecule. For example, a Cas9 molecule comprises an altered PI domain if its PI domain is other than the PI domain naturally associated with the Cas9 core domain of the Cas9 molecule, or if its PI domain is not a naturally occurring PI domain associated with any Cas9 molecule. (Derived, as used in this sense, is not limited to physical derivation or even derivation from a specific source, and does not require a process limitation, but in some embodiments, includes mere structural similarity). An altered PI domain may have less than 99, 98, 97, 96, 95, 94, 93, 92, 91, 90, 89, 88, 87, 86, 85, 84, 83, 82, 81, 80, 70, 60, 50, 30, 40, 30, 20, or 10% homology with the native or endogenous PI domain of a subject naturally occurring Cas9 molecule from which the Cas9 core domain is derived. An altered PI domain may have a different RKR motif (the PAM recognition sequence) than that of the native or endogenous PI domain of the Cas9 species that supplies the Cas9 core domain. The RKR motif of an altered PI domain may differ from the RKR motif of the native or endogenous PI domain of the Cas9 core domain by 1, 2, or 3 residues. The RKR motif of the altered PI differs at the first position, the second position, the third position, the first and second positions, the first and third positions, the second and third positions, or all three positions, from the RKR motif of the PI endogenous to or naturally associated with the Cas9 core domain. In an embodiment, an altered PI domain is one having greater homology with the PI domain of a reference or donor naturally occurring Cas9 molecule (a heterologous Cas9) that with the native PI domain of a subject Cas9.

The terms "homology" or "identity", as used interchangeably herein, refer to sequence identity between two amino acid sequences or two nucleic acid sequences, with identity being a more strict comparison. The phrases "percent identity or homology" and "% identity or homology" refer to the percentage of sequence identity found in a comparison of two or more amino acid sequences or nucleic acid sequences. Two or more sequences can be anywhere from 0-100% identical, or any value there between. Identity can be determined by comparing a position in each sequence that can be aligned for purposes of comparison to a reference sequence. When a position in the compared sequence is occupied by the same nucleotide base or amino acid, then the molecules are identical at that position. A degree of identity of amino acid sequences is a function of the number of identical amino acids at positions shared by the amino acid sequences. A degree of identity between nucleic acid sequences is a function of the number of identical or matching nucleotides at positions shared by the nucleic acid sequences. A degree of homology of amino acid sequences is a function of the number of amino acids at positions shared by the polypeptide sequences.

Calculations of homology or sequence identity between two sequences (the terms are used interchangeably herein) are performed as follows. The sequences are aligned for optimal comparison purposes (e.g., gaps can be introduced in one or both of a first and a second amino acid or nucleic acid sequence for optimal alignment and non-homologous sequences can be disregarded for comparison purposes). The optimal alignment is determined as the best score using the GAP program in the GCG software package with a Blossum 62 scoring matrix with a gap penalty of 12, a gap extend penalty of 4, and a frame shift gap penalty of 5. The amino acid residues or nucleotides at corresponding amino acid positions or nucleotide positions are then compared. When a position in the first sequence is occupied by the same amino acid residue or nucleotide as the corresponding position in the second sequence, then the molecules are identical at that position. The percent identity between the two sequences is a function of the number of identical positions shared by the sequences.

"Linker", as that term is used herein, refers to a molecular entity that may link a Cas9 molecule, or a fragment thereof, and a template binding domain, or may link a template binding domain partner to a template nucleic acid, or may link a Cas9 molecule fragment or domain to another Cas9 molecule fragment or domain. In one embodiment, the linker is a nucleic acid, e.g. an oligonucleotide. In another embodiment, the linker is a small molecule. In a further embodiment, the linker is a polypeptide comprising at least one amino acid. For example, a polypeptide linker may be disposed between sequences or domains of a Cas9 molecule. In an embodiment, the linker is disposed between the amino acid residues that flank a deletion. In an embodiment, the linker is disposed between the amino acid residues of a Cas9 core domain and an altered PI domain. By way of example, in a sequence $_{CT}1-_{CT}2-_{CT}3-_{CT}7-_{CT}8-_{CT}9$, wherein $_{CT}4-_{CT}5-_{CT}6$ is deleted, the linker is located immediately C-terminal to the amino acid residue $_{CT}3$ and immediately N-terminal to the amino acid residue $_{CT}7$. Preferably, the linker is selected such that the Cas9 molecule exhibits a tertiary structure or folded conformation similar to that of the corresponding naturally occurring Cas9 molecule, such that some Cas9 activity is retained. Suitable linkers are described herein. In some embodiments, the linker comprises a combination of Gly and Ser residues, e.g., $(GS)_x$(SEQ ID NO: 128) or $(GGS)_x$(SEQ ID NO: 1), where x is 1, 2, 3, 4, 5, 6, 7, 8, 9 or 10. In other embodiments, the linker comprises a linker comprising the amino acid sequence SGSETPGTSESATPES (SEQ ID NO: 2), referred to herein as XTEN linker or XTEN. Alternative linkers include $(GSAGSAAGSGEF)_x$, wherein x is 1, 2, 3 or 4 (SEQ ID NO: 3) and (SIVAQLSRPDPA)$_x$, wherein x is 1, 2, 3 or 4 (SEQ ID NO: 4). Linkers also include a combination of linkers described herein or known in the art.

"REC deletion", as that term is used herein, refers to a REC2 deletion, a REC1$_{CT}$ deletion, or a REC1$_{SUB}$ deletion.

"REC2 deletion", as that term is used herein, refers to a deletion of at least 10% of the amino acid residues of the REC2 domain.

"REC2 domain", as that term is used herein, refers to a region, in the N terminal half of a naturally occurring Cas9 molecule that is not needed for cleavage or gRNA-mediated targeting. Its length and boundaries differ between Cas9 molecules from various species. In the case of S. aureus, the REC2 domain is about 41 amino acid residues in length and corresponds, approximately, to residues 126 to 166, of S. aureus Cas9. In the case of S. pyogenes, the REC2 domain is about 139 amino acid residues in length and corresponds, approximately, to residues 176 to 314 of S. pyogenes Cas9. In the case of C. jejuni, the REC2 domain is about 45 amino acid residues in length and corresponds, approximately, to residues 137 to 181 of C. jejuni Cas9. These, and the approximate sizes and boundaries of REC2 domains from other species, are provided in Table 100.

"REC1$_{CT}$ deletion", as that term is used herein, refers to a deletion of at least 10% of the amino acid residues of the REC1$_{CT}$ domain.

"REC1$_{CT}$ domain", as that term is used herein, refers to a region, C terminal of the REC1 domain, of a naturally occurring Cas9 polypeptide that is not needed for cleavage or gRNA-mediated targeting. Its length and boundaries differ between Cas9 proteins from various species. In the case of S. aureus, the REC1$_{CT}$ domain is about 146 amino acid residues in length and corresponds, approximately, to residues 288 to 166, of S. aureus Cas9. In the case of S. pyogenes, the REC1$_{CT}$ domain is about 219 amino acid residues in length and corresponds, approximately, to residues 500 to 718 of S. pyogenes Cas9. In the case of C. jejuni, the REC1$_{CT}$ domain is about 134 amino acid residues in length and corresponds, approximately, to residues 305 to 438 of C. jejuni Cas9. These, and the approximate sizes and boundaries of REC1 $_{CT}$ domains from other species, are provided in Table 100.

"REC1 $_{SUB}$ deletion", as that term is used herein, refers to a deletion of at least 10% of the amino acid residues of the REC1$_{SUB}$ domain.

"REC1 $_{SUB}$ domain", as that term is used herein, refers to a region, located within the REC1 $_{CT}$ domain, of a naturally occurring Cas9 polypeptide that is not needed for cleavage or gRNA-mediated targeting. Its length and boundaries differ between Cas9 proteins from various species. In the case of S. aureus, the REC1$_{Sub}$ domain is about 57 amino acid residues in length and corresponds, approximately, to residues 296 to 352, of S. aureus Cas9. In the case of S. pyogenes, the REC1$_{Sub}$ domain is about 82 amino acid residues in length and corresponds, approximately, to residues 511 to 592 of S. pyogenes Cas9. In the case of C. jejuni, the REC1$_{Sub}$ domain is about 45 amino acid residues in length and corresponds, approximately, to residues 316 to 360 of C. jejuni Cas9. These, and the approximate sizes and boundaries of REC1$_{Sub}$ domains from other species, are provided in Table 100.

"n" as used herein in the context of proteins or Cas9 molecules described herein, refers to the number of amino acid residues that are deleted in a REC2, REC1$_{CT}$, or REC1$_{SUB}$ deletion, unless otherwise specified.

"X" as used herein in the context of an amino acid sequence of a linker sequence, refers to any number of repeating units unless otherwise specified.

A disorder "caused by" a mutation, as used herein, refers to a disorder that is made more likely or severe by the presence of the mutation, compared to a subject that does not have the mutation. The mutation need not be the only cause of a disorder, i.e., the disorder can still be caused by the mutation even if other causes, such as environmental factors or lifestyle factors, contribute causally to the disorder. In some embodiments, the disorder is caused by the mutation if the mutation is a medically recognized risk factor for developing the disorder, and/or if a study has found that the mutation correlates with development of the disorder.

"Derived from", as used herein, refers to the source or origin of a molecular entity, e.g., a nucleic acid or protein. The source of a molecular entity may be naturally-occurring, recombinant, unpurified, or a purified molecular entity. For example, a polypeptide that is derived from a second polypeptide comprises an amino acid sequence that is identical or substantially similar, e.g., is more than 50% homologous to, the amino acid sequence of the second protein. The derived molecular entity, e.g., a nucleic acid or protein, can comprise one or more modifications, e.g., one or more amino acid or nucleotide changes.

"Domain", as used herein, is used to describe segments of a protein or nucleic acid. Unless otherwise indicated, a domain is not required to have any specific functional property.

As used herein, "HDR", or homology-directed repair, refers to the process of repairing DNA damage using a homologous nucleic acid (e.g., a sister chromatid or an exogenous nucleic acid). In a normal cell, HDR typically involves a series of steps such as recognition of the break, stabilization of the break, resection, stabilization of single stranded DNA, formation of a DNA crossover intermediate, resolution of the crossover intermediate, and ligation.

"Large molecule", as used herein, refers to a molecule having a molecular weight of at least 2, 3, 5, 10, 20, 30, 40, 50, 60, 70, 80, 90, or 100 kDa. Large molecules include proteins, polypeptides, nucleic acids, biologics, and carbohydrates.

"Polypeptide", as used herein, refers to a polymer of amino acids.

"Reference molecule", e.g., a reference Cas9 molecule or reference gRNA, as used herein, refers to a molecule to which a subject molecule, e.g., a subject Cas9 molecule or a subject gRNA molecule, e.g., a modified or candidate Cas9 molecule, is compared. For example, a Cas9 molecule can be characterized as having no more than 10% of the nuclease activity of a reference Cas9 molecule. Examples of reference Cas9 molecules include naturally occurring unmodified Cas9 molecules, e.g., a naturally occurring Cas9 molecule such as a Cas9 molecule of S. aureus, S. pyogenes, or S. thermophilus. In an embodiment, the reference Cas9 molecule is the naturally occurring Cas9 molecule having the closest sequence identity or homology with the Cas9 molecule to which it is being compared. In an embodiment, the reference Cas9 molecule is a sequence, e.g., a naturally occurring or known sequence, which is the parental form on which a change, e.g., a mutation has been made.

"Replacement", or "replaced", as used herein with reference to a modification of a molecule does not require a process limitation but merely indicates that the replacement entity is present.

"Small molecule", as used herein, refers to a compound having a molecular weight less than about 2 kDa, e.g., less than about 2 kDa, less than about 1.5 kDa, less than about 1 kDa, or less than about 0.75 kDa.

"Steric interference" or "steric hindrance", as used herein, refers to the restriction or prevention of the binding or interaction of one molecular entity (e.g., a protein or a protein fragment) with another molecular entity (e.g., a nucleic acid or a protein).

"Subject", as used herein, may mean either a human or non-human animal. The term includes, but is not limited to, mammals (e.g., humans, other primates, pigs, rodents (e.g., mice and rats or hamsters), rabbits, guinea pigs, cows, horses, cats, dogs, sheep, and goats. In an embodiment, the subject is a human. In other embodiments, the subject is poultry.

"Sufficiently long", as the term is used herein to refer to linkers, refers to a linker length that does not prevent or restrict the binding folding, conformation, activity, and/or interaction of one molecular entity (e.g., a protein) with another molecular entity (e.g., a nucleic acid). In one embodiment, the linker is at least 6, but no longer than 60 amino acids in length. In another embodiment, the linker is at least 18, but no longer than 180 nucleotides in length. In one embodiment, the linker is at least 10, 50, 100, 200, 500, 1000, 2000, 5000, or 10000 Angstroms in length. In one embodiment, the linker is no more than 10, 50, 100, 200, 500, 1000, 2000, 5000, or 10000 Angstroms in length.

"Treat", "treating" and "treatment", as used herein, mean the treatment of a disease in a mammal, e.g., in a human, including (a) inhibiting the disease, i.e., arresting or preventing its development; (b) relieving the disease, i.e., causing regression of the disease state; and (c) curing the disease.

"Prevent," "preventing" and "prevention," as used herein, means the prevention of a disease in a subject, e.g., a mammal, e.g., in a human, including (a) avoiding or precluding the disease; (2) affecting the predisposition toward the disease, e.g., preventing at least one symptom of the disease or to delay onset of at least one symptom of the disease.

"Specific affinity", or "specifically binds", or "specific binding", as used herein, refer to a binding interaction between two or more molecular entities, e.g., a template binding domain and a template binding domain partner, such as, for example, a DNA-binding polypeptide and a DNA molecule, wherein one molecular entity preferentially binds to another molecular entity, but does not substantially bind to other molecular entities present in a molecular milieu, e.g., a heterologous molecular milieu, in a cell or in solution. In some embodiments, the term "specific affinity" refers to a DNA-binding protein or polypeptide that binds to a specific sequence of a nucleic acid molecule. Exemplary protein-protein pairs that specifically bind to each other are provided in Table V.6. Exemplary protein-small molecule pairs that specifically bind to each other are provided in Table V.7. Exemplary protein-DNA sequence pairs that specifically bind to each other are provided in Table V.1.

"Substantial affinity", as the term is used herein, refers to a binding interaction between two or more molecular entities, e.g., a template binding domain and a template binding domain partner, such as, for example, a DNA-binding polypeptide and a DNA molecule, wherein the binding event induces a significant event, change or alteration in the molecular entity being bound, or a significant phenotypic change in a cell in which the binding event occurs.

"Target position" or "target nucleic acid" as used herein, refers to a site on a nucleic acid (e.g., a region of a chromosome) that is modified by a Cas9 molecule-dependent process. For example, the target position can be modified by a Cas9 molecule-mediated cleavage of the nucleic acid using a template nucleic acid. In an embodiment, a target position can be a site between two nucleotides, e.g., adjacent nucleotides, on the target nucleic acid into which one or more nucleotides is added. The target position may comprise one or more nucleotides that are altered, e.g., corrected, by a template nucleic acid. In an embodiment, the target position is within a "target sequence" (e.g., the sequence to which the gRNA binds). In an embodiment, a target position is upstream or downstream of a target sequence (e.g., the sequence to which the gRNA binds).

The "targeting domain" of the gRNA is complementary to the "target domain" on the target nucleic acid.

A "template binding domain partner" as used herein, is a molecule with specific affinity for a template binding domain. The template binding domain partner may be, e.g., DNA, protein, or a small molecule.

A "template nucleic acid", as that term is used herein, refers to a nucleic acid sequence which can be used in conjunction with a Cas9 molecule and a gRNA molecule to alter the structure of a target position. "Template nucleic acid" is used interchangeably with "donor nucleic acid" and "swap nucleic acid" herein. In an embodiment, the target nucleic acid is modified to have some or all of the sequence of the template nucleic acid, typically at or near cleavage site(s). In an embodiment, the template nucleic acid is single stranded. In an alternate embodiment, the template nucleic acid is double stranded. In an embodiment, the template nucleic acid is DNA, e.g., double stranded DNA. In an alternate embodiment, the template nucleic acid is single stranded DNA. In an embodiment, the template nucleic acid is encoded on the same vector backbone, e.g. AAV genome, plasmid DNA, as the Cas9 and gRNA. In an embodiment, the template nucleic acid is excised from a vector backbone in vivo, e.g., it is flanked by gRNA recognition sequences.

"Wild type", as used herein, refers to a gene or polypeptide which has the characteristics, e.g., the nucleotide or amino acid sequence, of a gene or polypeptide from a naturally-occurring source. The term "wild type" typically includes the most frequent observation of a particular gene or polypeptide in a population of organisms found in nature.

"X" as used herein in the context of an amino acid sequence, refers to any amino acid (e.g., any of the twenty natural amino acids) unless otherwise specified.

A "template binding domain," as that term is used herein, refers to an entity which, by virtue of its specific affinity for a template binding domain partner, mediates the association of a template nucleic acid with a Cas9 with which the template binding domain is associated. The template binding domain associates with, e.g., by non-covalent or covalent interactions, with a template binding domain partner. The template binding domain partner is associated with, e.g., covalently or non-covalently bound to, the template nucleic acid. In an embodiment, the template binding domain comprises a polypeptide and the template binding domain partner comprises a nucleic acid. Typically, the template binding domain does not cleave nucleic acid.

I. GRNA Molecules

A gRNA molecule, as that term is used herein, refers to a nucleic acid that promotes the specific targeting or homing of a gRNA molecule/Cas9 molecule complex to a target nucleic acid. Typically, the nucleic acid will incorporate the functions or structure of both crRNA and tracrRNA, e.g., the functions of processed or mature crRNA and of processed or mature tracrRNA. gRNA molecules can be unimolecular (having a single nucleic acid molecule, e.g., which incorporates both crRNA function or structure and the tracrRNA function or structure), sometimes referred to herein as "chimeric" gRNAs, or modular (comprising more than one, and typically two, separate nucleic acid molecules, e.g., where one incorporates the crRNA function or structure and the other incorporates the tracrRNA function or structure). A gRNA molecule comprises a number of domains. The gRNA molecule domains are described in more detail below. Additional details on gRNAs are provided in Section I entitled "gRNA molecules" of PCT Application WO 2015/048577, the entire contents of which are expressly incorporated herein by reference.

In an embodiment, a unimolecular, or chimeric, gRNA comprises, preferably from 5' to 3': a targeting domain (which is complementary to a target nucleic acid, and which is sometimes referred to as a spacer); a first complementarity domain; a linking domain; a second complementarity domain (which is complementary to the first complementarity domain); a proximal domain; and optionally, a tail domain. In an embodiment, the targeting domain, and first complementarity domain correspond functionally or structurally to elements of a crRNA, e.g., a mature or processed crRNA. In an embodiment, the second complementarity domain, proximal domain, and tail domain correspond functionally or structurally to elements of a tracrRNA, e.g., a processed or mature tracrRNA.

In an embodiment, a modular gRNA comprises: a first strand (which corresponds to a crRNA) comprising, preferably from 5' to 3'; a targeting domain (which is complementary to a target nucleic acid); and a first complementarity domain; and a second strand (which corresponds to a tracrRNA), comprising preferably from 5' to 3': optionally, a 5' extension domain; a second complementarity domain; a proximal domain; and optionally, a tail domain.

The domains are discussed briefly below.
The Targeting Domain

The targeting domain (which can also be referred to as a "spacer") comprises a nucleotide sequence that is complementary, e.g., at least 80, 81, 82, 83, 84, 85, 86, 87, 88, 89, 90, 91, 92, 93, 94, 95, 96, 97, 98, or 99% complementary, e.g., fully complementary, to the target sequence on the target nucleic acid. The targeting domain is part of an RNA molecule and will therefore comprise the base uracil (U), while any DNA encoding the gRNA molecule will comprise the base thymine (T). While not wishing to be bound by theory, in an embodiment, it is believed that the complementarity of the targeting domain with the target sequence contributes to specificity of the interaction of the gRNA molecule/Cas9 molecule complex with a target nucleic acid. It is understood that in a targeting domain and target sequence pair, the uracil bases in the targeting domain will pair with the adenine bases in the target sequence. In an embodiment, the target domain itself comprises in the 5' to 3' direction, an optional secondary domain, and a core domain. In an embodiment, the core domain is fully complementary with the target sequence. In an embodiment, the targeting domain is 5 to 50 nucleotides in length, e.g., 10 to 30, e.g., 16, 17, 18, 19, 20, 21, 22, 23, 24, 25 or 26, nucleotides in length. The strand of the target nucleic acid with which the targeting domain is complementary is referred to herein as the complementary strand. Some or all of the nucleotides of the targeting domain can have a modification, e.g., a modification found in Section XI herein.

In an embodiment, the targeting domain is 16 nucleotides in length.
In an embodiment, the targeting domain is 17 nucleotides in length.
In an embodiment, the targeting domain is 18 nucleotides in length.
In an embodiment, the targeting domain is 19 nucleotides in length.
In an embodiment, the targeting domain is 20 nucleotides in length.
In an embodiment, the targeting domain is 21 nucleotides in length.
In an embodiment, the targeting domain is 22 nucleotides in length.
In an embodiment, the targeting domain is 23 nucleotides in length.
In an embodiment, the targeting domain is 24 nucleotides in length.
In an embodiment, the targeting domain is 25 nucleotides in length.
In an embodiment, the targeting domain is 26 nucleotides in length.
In an embodiment, the targeting domain comprises 16 nucleotides.
In an embodiment, the targeting domain comprises 17 nucleotides.
In an embodiment, the targeting domain comprises 18 nucleotides.
In an embodiment, the targeting domain comprises 19 nucleotides.
In an embodiment, the targeting domain comprises 20 nucleotides.
In an embodiment, the targeting domain comprises 21 nucleotides.
In an embodiment, the targeting domain comprises 22 nucleotides.
In an embodiment, the targeting domain comprises 23 nucleotides.
In an embodiment, the targeting domain comprises 24 nucleotides.
In an embodiment, the targeting domain comprises 25 nucleotides.
In an embodiment, the targeting domain comprises 26 nucleotides.

Targeting domains are discussed in more detail below.
The First Complementarity Domain The first complementarity domain is complementary with the second complementarity domain, and in an embodiment, has sufficient complementarity to the second complementarity domain to form a duplexed region under at least some physiological conditions. In an embodiment, the first complementarity domain is 5 to 30 nucleotides in length. In an embodiment, the first complementarity domain is 5 to 25 nucleotides in length. In an embodiment, the first complementary domain is 7 to 25 nucleotides in length. In an embodiment, the first complementary domain is 7 to 22 nucleotides in length. In an embodiment, the first complementary domain is 7 to 18 nucleotides in length. In an embodiment, the first complementary domain is 7 to 15 nucleotides in length. In an embodiment, the first complementary domain is 5, 6, 7, 8, 9, 10, 11, 12, 13, 14, 15, 16, 17, 18, 19, 20, 21, 22, 23, 24, or 25 nucleotides in length.

In an embodiment, the first complementarity domain comprises 3 subdomains, which, in the 5' to 3' direction are: a 5' subdomain, a central subdomain, and a 3' subdomain. In an embodiment, the 5' subdomain is 4 to 9, e.g., 4, 5, 6, 7, 8 or 9 nucleotides in length. In an embodiment, the central subdomain is 1, 2, or 3, e.g., 1, nucleotide in length. In an embodiment, the 3' subdomain is 3 to 25, e.g., 4 to 22, 4 to 18, or 4 to 10, or 3, 4, 5, 6, 7, 8, 9, 10, 11, 12, 13, 14, 15, 16, 17, 18, 19, 20, 21, 22, 23, 24, or 25 nucleotides in length.

The first complementarity domain can share homology with, or be derived from, a naturally occurring first complementarity domain. In an embodiment, it has at least 50% homology with a first complementarity domain disclosed herein, e.g., an *S. pyogenes, S. aureus* or *S. thermophilus*, first complementarity domain.

Some or all of the nucleotides of the domain can have a modification, e.g., a modification found in Section XI herein.

First complementarity domains are discussed in more detail below.

The Linking Domain

A linking domain serves to link the first complementarity domain with the second complementarity domain of a unimolecular gRNA. The linking domain can link the first and second complementarity domains covalently or non-covalently. In an embodiment, the linkage is covalent. In an embodiment, the linking domain covalently couples the first and second complementarity domains. In an embodiment, the linking domain is, or comprises, a covalent bond interposed between the first complementarity domain and the second complementarity domain. Typically the linking domain comprises one or more, e.g., 2, 3, 4, 5, 6, 7, 8, 9, or 10 nucleotides.

In modular gRNA molecules the two molecules are associated by virtue of the hybridization of the complementarity domains.

A wide variety of linking domains are suitable for use in unimolecular gRNA molecules. Linking domains can consist of a covalent bond, or be as short as one or a few nucleotides, e.g., 1, 2, 3, 4, or 5 nucleotides in length. In an embodiment, a linking domain is 2, 3, 4, 5, 6, 7, 8, 9, 10, 15, 20, or 25 or more nucleotides in length. In an embodiment, a linking domain is 2 to 50, 2 to 40, 2 to 30, 2 to 20, 2 to 10, or 2 to 5 nucleotides in length. In an embodiment, a linking domain shares homology with, or is derived from, a naturally occurring sequence, e.g., the sequence of a tracrRNA that is 5' to the second complementarity domain. In an embodiment, the linking domain has at least 50% homology with a linking domain disclosed herein.

Some or all of the nucleotides of the domain can have a modification, e.g., a modification found in Section XI herein.

Linking domains are discussed in more detail below.

The 5' Extension Domain

In an embodiment, a modular gRNA can comprise additional sequence, 5' to the second complementarity domain, referred to herein as the 5' extension domain. In an embodiment, the 5' extension domain is, 2 to 10, 2 to 9, 2 to 8, 2 to 7, 2 to 6, 2 to 5, or 2 to 4, nucleotides in length. In an embodiment, the 5' extension domain is 2, 3, 4, 5, 6, 7, 8, 9, or 10 or more nucleotides in length.

The Second Complementarity Domain

The second complementarity domain is complementary with the first complementarity domain, and in an embodiment, has sufficient complementarity to the second complementarity domain to form a duplexed region under at least some physiological conditions. In an embodiment, the second complementarity domain can include sequence that lacks complementarity with the first complementarity domain, e.g., sequence that loops out from the duplexed region.

In an embodiment, the second complementarity domain is 5 to 27 nucleotides in length. In an embodiment, it is longer than the first complementarity region. In an embodiment the second complementarity domain is 7 to 27 nucleotides in length. In an embodiment, the second complementary domain is 7 to 25 nucleotides in length. In an embodiment, the second complementary domain is 7 to 20 nucleotides in length. In an embodiment, the second complementary domain is 7 to 17 nucleotides in length. In an embodiment, the complementary domain is 5, 6, 7, 8, 9, 10, 11, 12, 13, 14, 15, 16, 17, 18, 19, 20, 21, 22, 23, 24, 25 or 26 nucleotides in length.

In an embodiment, the second complementarity domain comprises 3 subdomains, which, in the 5' to 3' direction are: a 5' subdomain, a central subdomain, and a 3' subdomain. In an embodiment, the 5' subdomain is 3 to 25, e.g., 4 to 22, 4 to 18, or 4 to 10, or 3, 4, 5, 6, 7, 8, 9, 10, 11, 12, 13, 14, 15, 16, 17, 18, 19, 20, 21, 22, 23, 24, or 25 nucleotides in length. In an embodiment, the central subdomain is 1, 2, 3, 4 or 5, e.g., 3, nucleotides in length. In an embodiment, the 3' subdomain is 4 to 9, e.g., 4, 5, 6, 7, 8 or 9 nucleotides in length.

In an embodiment, the 5' subdomain and the 3' subdomain of the first complementarity domain, are respectively, complementary, e.g., fully complementary, with the 3' subdomain and the 5' subdomain of the second complementarity domain.

The second complementarity domain can share homology with or be derived from a naturally occurring second complementarity domain. In an embodiment, it has at least 50% homology with a second complementarity domain disclosed herein, e.g., an *S. pyogenes, S. aureus* or *S. thermophilus*, first complementarity domain.

Some or all of the nucleotides of the domain can have a modification, e.g., a modification found in Section XI herein.

A Proximal Domain

In an embodiment, the proximal domain is 5 to 20 nucleotides in length. In an embodiment, the proximal domain can share homology with or be derived from a naturally occurring proximal domain. In an embodiment, it has at least 50% homology with a proximal domain disclosed herein, e.g., an *S. pyogenes, S. aureus* or *S. thermophilus*, proximal domain.

Some or all of the nucleotides of the domain can have a modification, e.g., a modification found in Section XI herein.

A Tail Domain

A broad spectrum of tail domains are suitable for use in gRNA molecules. In an embodiment, the tail domain is 0 (absent), 1, 2, 3, 4, 5, 6, 7, 8, 9, or 10 nucleotides in length. In embodiment, the tail domain nucleotides are from or share homology with sequence from the 5' end of a naturally occurring tail domain. In an embodiment, the tail domain includes sequences that are complementary to each other and which, under at least some physiological conditions, form a duplexed region.

In an embodiment, the tail domain is absent or is 1 to 50 nucleotides in length. In an embodiment, the tail domain can share homology with or be derived from a naturally occurring proximal tail domain. In an embodiment, it has at least 50% homology with a tail domain disclosed herein, e.g., an *S. pyogenes, S. aureus* or *S. thermophilus*, tail domain. In an embodiment, the tail domain includes nucleotides at the 3' end that are related to the method of in vitro or in vivo transcription. When a T7 promoter is used for in vitro transcription of the gRNA, these nucleotides may be any nucleotides present before the 3' end of the DNA template. When a U6 promoter is used for in vivo transcription, these nucleotides may be the sequence UUUUUU. When alternate pol-III promoters are used, these nucleotides may be various numbers or uracil bases or may include alternate bases.

The domains of gRNA molecules are described in more detail below.

The Targeting Domain

The "targeting domain" of the gRNA is complementary to the "target domain" on the target nucleic acid. The strfnd of the target nucleic acid comprising the nucleotide sequence complementary to the core domain of the gRNA is referred to herein as the "complementary strand" of the target nucleic acid. Guidance on the selection of targeting domains can be found, e.g., in Fu Y et al. (2014) NAT. BIOTECHNOL. 32: 279-84 (doi: 10.1038/nbt.2808) and Sternberg S H et al. (2014) NATURE 507: 62-7 (doi: 10.1038/nature13011).

In an embodiment, the targeting domain is 16, 17, 18, 19, 20, 21, 22, 23, 24, 25 or 26 nucleotides in length.

In an embodiment, the targeting domain is 16 nucleotides in length.

In an embodiment, the targeting domain is 17 nucleotides in length.

In an embodiment, the targeting domain is 18 nucleotides in length.

In an embodiment, the targeting domain is 19 nucleotides in length.

In an embodiment, the targeting domain is 20 nucleotides in length.

In an embodiment, the targeting domain is 21 nucleotides in length.

In an embodiment, the targeting domain is 22 nucleotides in length.

In an embodiment, the targeting domain is 23 nucleotides in length.

In an embodiment, the targeting domain is 24 nucleotides in length.

In an embodiment, the targeting domain is 25 nucleotides in length.

In an embodiment, the targeting domain is 26 nucleotides in length.

In an embodiment, the targeting domain comprises 16 nucleotides.

In an embodiment, the targeting domain comprises 17 nucleotides.

In an embodiment, the targeting domain comprises 18 nucleotides.

In an embodiment, the targeting domain comprises 19 nucleotides.

In an embodiment, the targeting domain comprises 20 nucleotides.

In an embodiment, the targeting domain comprises 21 nucleotides.

In an embodiment, the targeting domain comprises 22 nucleotides.

In an embodiment, the targeting domain comprises 23 nucleotides.

In an embodiment, the targeting domain comprises 24 nucleotides.

In an embodiment, the targeting domain comprises 25 nucleotides.

In an embodiment, the targeting domain comprises 26 nucleotides.

In an embodiment, the targeting domain is 10+/−5, 20+/−5, 30+/−5, 40+/−5, 50+/−5, 60+/−5, 70+/−5, 80+/−5, 90+/−5, or 100+/−5 nucleotides, in length.

In an embodiment, the targeting domain is 20+/−5 nucleotides in length.

In an embodiment, the targeting domain is 20+/−10, 30+/−10, 40+/−10, 50+/−10, 60+/−10, 70+/−10, 80+/−10, 90+/−10, or 100+/−10 nucleotides, in length.

In an embodiment, the targeting domain is 30+/−10 nucleotides in length.

In an embodiment, the targeting domain is 10 to 100, 10 to 90, 10 to 80, 10 to 70, 10 to 60, 10 to 50, 10 to 40, 10 to 30, 10 to 20 or 10 to 15 nucleotides in length.

In another embodiment, the targeting domain is 20 to 100, 20 to 90, 20 to 80, 20 to 70, 20 to 60, 20 to 50, 20 to 40, 20 to 30, or 20 to 25 nucleotides in length.

Typically the targeting domain has full complementarity with the target sequence. In an embodiment the targeting domain has or includes 1, 2, 3, 4, 5, 6, 7 or 8 nucleotides that are not complementary with the corresponding nucleotide of the targeting domain.

In an embodiment, the target domain includes 1, 2, 3, 4 or 5 nucleotides that are complementary with the corresponding nucleotide of the targeting domain within 5 nucleotides of its 5' end. In an embodiment, the target domain includes 1, 2, 3, 4 or 5 nucleotides that are complementary with the corresponding nucleotide of the targeting domain within 5 nucleotides of its 3' end.

In an embodiment, the target domain includes 1, 2, 3, or 4 nucleotides that are not complementary with the corresponding nucleotide of the targeting domain within 5 nucleotides of its 5' end. In an embodiment, the target domain includes 1, 2, 3, or 4 nucleotides that are not complementary with the corresponding nucleotide of the targeting domain within 5 nucleotides of its 3' end.

In an embodiment, the degree of complementarity, together with other properties of the gRNA, is sufficient to allow targeting of a Cas9 fusion molecule to the target nucleic acid.

In an embodiment, the targeting domain comprises two consecutive nucleotides that are not complementary to the target domain ("non-complementary nucleotides"), e.g., two consecutive noncomplementary nucleotides that are within 5 nucleotides of the 5' end of the targeting domain, within 5 nucleotides of the 3' end of the targeting domain, or more than 5 nucleotides away from one or both ends of the targeting domain.

In an embodiment, no two consecutive nucleotides within 5 nucleotides of the 5' end of the targeting domain, within 5 nucleotides of the 3' end of the targeting domain, or within a region that is more than 5 nucleotides away from one or both ends of the targeting domain, are not complementary to the targeting domain.

In an embodiment, there are no non-complementary nucleotides within 5 nucleotides of the 5' end of the targeting domain, within 5 nucleotides of the 3' end of the targeting domain, or within a region that is more than 5 nucleotides away from one or both ends of the targeting domain.

In an embodiment, the targeting domain nucleotides do not comprise modifications, e.g., modifications of the type provided in Section XI. However, in an embodiment, the targeting domain comprises one or more modifications, e.g., modifications that it render it less susceptible to degradation or more bio-compatible, e.g., less immunogenic. By way of example, the backbone of the targeting domain can be modified with a phosphorothioate, or other modification from Section XI. In an embodiment, a nucleotide of the targeting domain can comprise a 2' modification (e.g., a modification at the 2' position on ribose), e.g., a 2-acetylation, e.g., a 2' methylation, or other modification(s) from Section XI.

In an embodiment, the targeting domain includes 1, 2, 3, 4, 5, 6, 7 or 8 or more modifications. In an embodiment, the targeting domain includes 1, 2, 3, or 4 modifications within 5 nucleotides of its 5' end. In an embodiment, the targeting domain comprises as many as 1, 2, 3, or 4 modifications within 5 nucleotides of its 3' end.

In an embodiment, the targeting domain comprises modifications at two consecutive nucleotides, e.g., two consecutive nucleotides that are within 5 nucleotides of the 5' end of the targeting domain, within 5 nucleotides of the 3' end of the targeting domain, or more than 5 nucleotides away from one or both ends of the targeting domain.

In an embodiment, no two consecutive nucleotides are modified within 5 nucleotides of the 5' end of the targeting domain, within 5 nucleotides of the 3' end of the targeting domain, or within a region that is more than 5 nucleotides away from one or both ends of the targeting domain. In an embodiment, no nucleotide is modified within 5 nucleotides of the 5' end of the targeting domain, within 5 nucleotides of the 3' end of the targeting domain, or within a region that is more than 5 nucleotides away from one or both ends of the targeting domain.

Modifications in the targeting domain can be selected to not interfere with targeting efficacy, which can be evaluated by testing a candidate modification in the system described in Section VII gRNAs having a candidate targeting domain having a selected length, sequence, degree of complementarity, or degree of modification, can be evaluated in a system in Section VII. The candidate targeting domain can be placed, either alone, or with one or more other candidate changes in a gRNA molecule/Cas9 molecule system known to be functional with a selected target and evaluated.

In an embodiment, all of the modified nucleotides are complementary to and capable of hybridizing to corresponding nucleotides present in the target domain. In another embodiment, 1, 2, 3, 4, 5, 6, 7 or 8 or more modified nucleotides are not complementary to or capable of hybridizing to corresponding nucleotides present in the target domain.

In an embodiment, the targeting domain comprises, preferably in the 5'→3' direction: a secondary domain and a core domain. These domains are discussed in more detail below.

The Core Domain and Secondary Domain of the Targeting Domain

The "core domain" of the targeting domain is complementary to the "core domain target" on the target nucleic acid. In an embodiment, the core domain comprises about 8 to about 13 nucleotides from the 3' end of the targeting domain (e.g., the most 3' 8 to 13 nucleotides of the targeting domain).

In an embodiment, the core domain of the targeting domain and core domain target, are independently, 6+/−2, 7+/−2, 8+/−2, 9+/−2, 10+/−2, 11+/−2, 12+/−2, 13+/−2, 14+/−2, 15+/−2, or 16++−2, nucleotides in length.

In an embodiment, the core domain of the targeting domain and core domain target, are independently, 10+/−2 nucleotides in length.

In an embodiment, the core domain of the targeting domain and core domain target, are independently, 10+/−4 nucleotides in length.

In an embodiment, the core domain of the targeting domain and core domain target are independently 6, 7, 8, 9, 10, 11, 12, 13, 14, 15, 16, 17, or 18 nucleotides in length. In an embodiment, the core domain of the targeting domain and core domain target are independently 3 to 20, 4 to 20, 5 to 20, 6 to 20, 7 to 20, 8 to 20, 9 to 20 10 to 20 or 15 to 20 nucleotides in length.

In an embodiment, the core domain of the targeting domain and core domain target are independently 3 to 15, e.g., 6 to 15, 7 to 14, 7 to 13, 6 to 12, 7 to 12, 7 to 11, 7 to 10, 8 to 14, 8 to 13, 8 to 12, 8 to 11, 8 to 10 or 8 to 9 nucleotides in length.

The core domain of the targeting domain is complementary with the core domain target. Typically the core domain has exact complementarity with the core domain target. In an embodiment, the core domain of the targeting domain can have 1, 2, 3, 4 or 5 nucleotides that are not complementary with the corresponding nucleotide of the core domain target. In an embodiment, the degree of complementarity, together with other properties of the gRNA molecule, is sufficient to allow targeting of a Cas9 molecule to the target nucleic acid.

The "secondary domain" of the targeting domain of the gRNA is complementary to the "secondary domain target" of the target nucleic acid.

In an embodiment, the secondary domain is positioned 5' to the core domain.

In an embodiment, the secondary domain is absent or optional.

In an embodiment, if the targeting domain is 26 nucleotides in length and the core domain (counted from the 3' end of the targeting domain) is 8 to 13 nucleotides in length, the secondary domain is 13 to 18 nucleotides in length.

In an embodiment, if the targeting domain is 25 nucleotides in length and the core domain (counted from the 3' end of the targeting domain) is 8 to 13 nucleotides in length, the secondary domain is 12 to 17 nucleotides in length.

In an embodiment, if the targeting domain is 24 nucleotides in length and the core domain (counted from the 3' end of the targeting domain) is 8 to 13 nucleotides in length, the secondary domain is 11 to 16 nucleotides in length.

In an embodiment, if the targeting domain is 23 nucleotides in length and the core domain (counted from the 3' end of the targeting domain) is 8 to 13 nucleotides in length, the secondary domain is 10 to 15 nucleotides in length.

In an embodiment, if the targeting domain is 22 nucleotides in length and the core domain (counted from the 3' end of the targeting domain) is 8 to 13 nucleotides in length, the secondary domain is 9 to 14 nucleotides in length.

In an embodiment, if the targeting domain is 21 nucleotides in length and the core domain (counted from the 3' end of the targeting domain) is 8 to 13 nucleotides in length, the secondary domain is 8 to 13 nucleotides in length.

In an embodiment, if the targeting domain is 20 nucleotides in length and the core domain (counted from the 3' end of the targeting domain) is 8 to 13 nucleotides in length, the secondary domain is 7 to 12 nucleotides in length.

In an embodiment, if the targeting domain is 19 nucleotides in length and the core domain (counted from the 3' end of the targeting domain) is 8 to 13 nucleotides in length, the secondary domain is 6 to 11 nucleotides in length.

In an embodiment, if the targeting domain is 18 nucleotides in length and the core domain (counted from the 3' end of the targeting domain) is 8 to 13 nucleotides in length, the secondary domain is 5 to 10 nucleotides in length.

In an embodiment, if the targeting domain is 17 nucleotides in length and the core domain (counted from the 3' end of the targeting domain) is 8 to 13 nucleotides in length, the secondary domain is 4 to 9 nucleotides in length.

In an embodiment, if the targeting domain is 16 nucleotides in length and the core domain (counted from the 3' end of the targeting domain) is 8 to 13 nucleotides in length, the secondary domain is 3 to 8 nucleotides in length.

In an embodiment, the secondary domain is 0, 1, 2, 3, 4, 5, 6, 7, 8, 9, 10, 11, 12, 13, 14, 15, 16, 17, or 18 nucleotides in length.

The secondary domain of the targeting domain is complementary with the secondary domain target. Typically the secondary domain of the targeting domain has exact complementarity with the secondary domain target. In an embodiment the secondary domain of the targeting domain can have 1, 2, 3, 4 or 5 nucleotides that are not complementary with the corresponding nucleotide of the secondary domain target. In an embodiment, the degree of complementarity, together with other properties of the gRNA, is sufficient to allow targeting of a Cas9 fusion molecule to the target nucleic acid.

In an embodiment, the core domain nucleotides do not comprise modifications, e.g., modifications of the type provided in Section XI. However, in an embodiment, the core domain comprises one or more modifications, e.g., modifications that it render it less susceptible to degradation or more bio-compatible, e.g., less immunogenic. By way of example, the backbone of the core domain can be modified with a phosphorothioate, or other modification(s) from Section XI. In an embodiment a nucleotide of the core domain can comprise a 2' modification (e.g., a modification at the 2' position on ribose), e.g., a 2-acetylation, e.g., a 2' methylation, or other modification(s) from Section XI. Typically, a core domain will contain no more than 1, 2, or 3 modifications.

Modifications in the core domain can be selected to not interfere with targeting efficacy, which can be evaluated by testing a candidate modification in the system described in Section VII gRNAs having a candidate core domain having a selected length, sequence, degree of complementarity, or degree of modification, can be evaluated in the system described at Section VII. The candidate core domain can be placed, either alone, or with one or more other candidate changes in a gRNA molecule/Cas9 molecule system known to be functional with a selected target and evaluated.

In an embodiment, the secondary domain nucleotides do not comprise modifications, e.g., modifications of the type provided in Section XI. However, in an embodiment, the secondary domain comprises one or more modifications, e.g., modifications that render it less susceptible to degradation or more bio-compatible, e.g., less immunogenic. By way of example, the backbone of the secondary domain can be modified with a phosphorothioate, or other modification(s) from Section XI. In an embodiment a nucleotide of the secondary domain can comprise a 2' modification (e.g., a modification at the 2' position on ribose), e.g., a 2-acetylation, e.g., a 2' methylation, or other modification from Section XI. Typically, a secondary domain will contain no more than 1, 2, or 3 modifications.

Modifications in the secondary domain can be selected to not interfere with targeting efficacy, which can be evaluated by testing a candidate modification in the system described in Section VII. gRNAs having a candidate secondary domain having a selected length, sequence, degree of complementarity, or degree of modification, can be evaluated in the system described at Section VII. The candidate secondary domain can be placed, either alone, or with one or more other candidate changes in a gRNA molecule/Cas9 molecule system known to be functional with a selected target and evaluated.

In an embodiment, (1) the degree of complementarity between the core domain of the targeting domain and its target (i.e., the core domain target), and (2) the degree of complementarity between the secondary domain of the targeting domain and its target (i.e., the secondary domain target), may differ. In an embodiment, (1) may be greater than (2). In an embodiment, (1) may be less than (2). In an embodiment, (1) and (2) are the same, e.g., each may be completely complementary with its target.

In an embodiment, (1) the number of modifications (e.g., modifications from Section XI) of the nucleotides of the core domain and (2) the number of modification (e.g., modifications from Section XI) of the nucleotides of the secondary domain, may differ. In an embodiment, (1) may be less than (2). In an embodiment, (1) may be greater than (2). In an embodiment, (1) and (2) may be the same, e.g., each may be free of modifications.

The First and Second Complementarity Domains

The first complementarity domain is complementary with the second complementarity domain.

Typically the first domain does not have exact complementarity with the second complementarity domain. In an embodiment, the first complementarity domain can have 1, 2, 3, 4 or 5 nucleotides that are not complementary with the corresponding nucleotide of the second complementarity domain. In an embodiment, 1, 2, 3, 4, 5 or 6, e.g., 3 nucleotides, will not pair in the duplex, and, e.g., form a non-duplexed or looped-out region. In an embodiment, an unpaired, or loop-out, region, e.g., a loop-out of 3 nucleotides, is present on the second complementarity domain. In an embodiment, the unpaired region begins 1, 2, 3, 4, 5, or 6, e.g., 4, nucleotides from the 5' end of the second complementarity domain.

In an embodiment, the degree of complementarity, together with other properties of the gRNA, is sufficient to allow targeting of a Cas9 molecule to the target nucleic acid.

In an embodiment, the first and second complementarity domains are:

independently, 6+/−2, 7+/−2, 8+/−2, 9+/−2, 10+/−2, 11+/−2, 12+/−2, 13+/−2, 14+/−2, 15+/−2, 16+/−2, 17+/−2, 18+/−2, 19+/−2, or 20+/−2, 21+/−2, 22+/−2, 23+/−2, or 24+/−2 nucleotides in length;

independently, 6, 7, 8, 9, 10, 11, 12, 13, 14, 14, 16, 17, 18, 19, 20, 21, 22, 23, 24, 25, or 26, nucleotides in length; or independently, 5 to 24, 5 to 23, 5 to 22, 5 to 21, 5 to 20, 7 to 18, 9 to 16, or 10 to 14 nucleotides in length.

In an embodiment, the second complementarity domain is longer than the first complementarity domain, e.g., 2, 3, 4, 5, or 6, e.g., 6, nucleotides longer.

In an embodiment, the first and second complementary domains, independently, do not comprise modifications, e.g., modifications of the type provided in Section XI.

In an embodiment, the first and second complementary domains, independently, comprise one or more modifications, e.g., modifications that the render the domain less susceptible to degradation or more bio-compatible, e.g., less immunogenic. By way of example, the backbone of the domain can be modified with a phosphorothioate, or other modification(s) from Section XI. In an embodiment a nucleotide of the domain can comprise a 2' modification (e.g., a modification at the 2' position on ribose), e.g., a 2-acetylation, e.g., a 2' methylation, or other modification(s) from Section XI.

In an embodiment, the first and second complementary domains, independently, include 1, 2, 3, 4, 5, 6, 7 or 8 or more modifications. In an embodiment, the first and second complementary domains, independently, include 1, 2, 3, or 4 modifications within 5 nucleotides of its 5' end. In an embodiment, the first and second complementary domains, independently, include as many as 1, 2, 3, or 4 modifications within 5 nucleotides of its 3' end.

In an embodiment, the first and second complementary domains, independently, include modifications at two consecutive nucleotides, e.g., two consecutive nucleotides that are within 5 nucleotides of the 5' end of the domain, within 5 nucleotides of the 3' end of the domain, or more than 5 nucleotides away from one or both ends of the domain. In an embodiment, the first and second complementary domains, independently, include no two consecutive nucleotides that are modified, within 5 nucleotides of the 5' end of the domain, within 5 nucleotides of the 3' end of the domain, or within a region that is more than 5 nucleotides away from one or both ends of the domain. In an embodiment, the first and second complementary domains, independently, include no nucleotide that is modified within 5 nucleotides of the 5' end of the domain, within 5 nucleotides of the 3' end of the domain, or within a region that is more than 5 nucleotides away from one or both ends of the domain.

Modifications in a complementarity domain can be selected to not interfere with targeting efficacy, which can be evaluated by testing a candidate modification in the system described in Section VII. gRNAs having a candidate complementarity domain having a selected length, sequence, degree of complementarity, or degree of modification, can be evaluated in the system described in Section VII. The candidate complementarity domain can be placed, either alone, or with one or more other candidate changes in a gRNA molecule/Cas9 molecule system known to be functional with a selected target and evaluated.

In an embodiment, the first complementarity domain has at least 60, 70, 80, 81, 82, 83, 84, 85, 86, 87, 88, 89, 90, 91, 92, 93, 94, 95, 96, 97, 98, 99% homology with, or differs by no more than 1, 2, 3, 4, 5, or 6 nucleotides from, a reference first complementarity domain, e.g., a naturally occurring e.g., an *S. pyogenes, S. aureus* or *S. thermophilus*, first complementarity domain, or a first complementarity domain described herein.

In an embodiment, the second complementarity domain has at least 60, 70, 80, 81, 82, 83, 84, 85, 86, 87, 88, 89, 90, 91, 92, 93, 94, 95, 96, 97, 98, 99% homology with, or differs by no more than 1, 2, 3, 4, 5, or 6 nucleotides from, a reference second complementarity domain, e.g., a naturally occurring, e.g., an *S. pyogenes, S. aureus* or *S. thermophilus*, second complementarity domain, or a second complementarity domain described herein.

The duplexed region formed by first and second complementarity domains is typically 6, 7, 8, 9, 10, 11, 12, 13, 14, 15, 16, 17, 18, 19, 20, 21 or 22 base pairs in length (excluding any looped out or unpaired nucleotides).

In an embodiment, the first and second complementary domains, when duplexed, comprise 11 paired nucleotides, for example, in the gRNA sequence (one paired strand underlined, one bolded):

(SEQ ID NO: 5)
NNNNNNNNNNNNNNNNNNNNNNNGUUUUAGAGCUAGAAAUAGCAAGUUAAAAU

AAGGCUAGUCCGUUAUCAACUUGAAAAAGUGGCACCGAGUCGGUGC.

In an embodiment, the first and second complementary domains, when duplexed, comprise 15 paired nucleotides, for example in the gRNA sequence (one paired strand underlined, one bolded):

(SEQ ID NO: 90)
NNNNNNNNNNNNNNNNNNNNNNNGUUUUAGAGCUAUGCUGAAAAGCAUAGCAA

GUUAAAAUAAGGCUAGUCCGUUAUCAACUUGAAAAAGUGGCACCGAGUCG

GUGC.

In an embodiment the first and second complementarity domains, when duplexed, comprise 16 paired nucleotides, for example in the gRNA sequence (one paired strand underlined, one bolded):

(SEQ ID NO: 91)
NNNNNNNNNNNNNNNNNNNNNNNGUUUUAGAGCUAUGCUGGAAACAGCAUAGC

AAGUUAAAAUAAGGCUAGUCCGUUAUCAACUUGAAAAAGUGGCACCGAGU

CGGUGC.

In an embodiment the first and second complementarity domains, when duplexed, comprise 21 paired nucleotides, for example in the gRNA sequence (one paired strand underlined, one bolded):

(SEQ ID NO: 92)
NNNNNNNNNNNNNNNNNNNNNNNGUUUUAGAGCUAUGCUGUUUUGGAAACAAA

ACAGCAUAGCAAGUUAAAAUAAGGCUAGUCCGUUAUCAACUUGAAAAAGU

GGCACCGAGUCGGUGC.

In an embodiment, nucleotides are exchanged to remove poly-U tracts, for example in the gRNA sequences (exchanged nucleotides underlined):

(SEQ ID NO: 93)
NNNNNNNNNNNNNNNNNNNNNNNGUAUUAGAGCUAGAAAUAGCAAGUUAAUAU

AAGGCUAGUCCGUUAUCAACUUGAAAAAGUGGCACCGAGUCGGUGC;

(SEQ ID NO: 94)
NNNNNNNNNNNNNNNNNNNNNNNGUUUAAGAGCUAGAAAUAGCAAGUUUAAAU

AAGGCUAGUCCGUUAUCAACUUGAAAAAGUGGCACCGAGUCGGUGC;
or (SEQ ID NO: 95)
NNNNNNNNNNNNNNNNNNNNNNNGUAUUAGAGCUAUGCUGUAUUGGAAACAAU

ACAGCAUAGCAAGUUAAUAUAAGGCUAGUCCGUUAUCAACUUGAAAAAGU

GGCACCGAGUCGGUGC.

The 5' Extension Domain

In an embodiment, a modular gRNA can comprise additional sequence, 5' to the second complementarity domain. In an embodiment, the 5' extension domain is 2 to 10, 2 to 9, 2 to 8, 2 to 7, 2 to 6, 2 to 5, or 2 to 4 nucleotides in length. In an embodiment, the 5' extension domain is 2, 3, 4, 5, 6, 7, 8, 9, or 10 or more nucleotides in length.

In an embodiment, the 5' extension domain nucleotides do not comprise modifications, e.g., modifications of the type provided in Section XI. However, in an embodiment, the 5' extension domain comprises one or more modifications, e.g., modifications that it render it less susceptible to degradation or more bio-compatible, e.g., less immunogenic. By way of example, the backbone of the 5' extension domain can be modified with a phosphorothioate, or other modification(s) from Section XI. In an embodiment, a nucleotide of the 5' extension domain can comprise a 2' modification (e.g., a modification at the 2' position on ribose), e.g., a 2-acetylation, e.g., a 2' methylation, or other modification(s) from Section XI.

In an embodiment, the 5' extension domain can comprise as many as 1, 2, 3, 4, 5, 6, 7 or 8 modifications. In an embodiment, the 5' extension domain comprises as many as 1, 2, 3, or 4 modifications within 5 nucleotides of its 5' end, e.g., in a modular gRNA molecule. In an embodiment, the 5' extension domain comprises as many as 1, 2, 3, or 4 modifications within 5 nucleotides of its 3' end, e.g., in a modular gRNA molecule.

In an embodiment, the 5' extension domain comprises modifications at two consecutive nucleotides, e.g., two consecutive nucleotides that are within 5 nucleotides of the 5' end of the 5' extension domain, within 5 nucleotides of the 3' end of the 5' extension domain, or more than 5 nucleotides away from one or both ends of the 5' extension domain. In an embodiment, no two consecutive nucleotides are modified within 5 nucleotides of the 5' end of the 5' extension domain, within 5 nucleotides of the 3' end of the 5' extension domain, or within a region that is more than 5 nucleotides away from one or both ends of the 5' extension domain. In an embodiment, no nucleotide is modified within 5 nucleotides of the 5' end of the 5' extension domain, within 5 nucleotides of the 3' end of the 5' extension domain, or within a region that is more than 5 nucleotides away from one or both ends of the 5' extension domain.

Modifications in the 5' extension domain can be selected so as to not interfere with gRNA molecule efficacy, which can be evaluated by testing a candidate modification in the system described in Section VII. gRNAs having a candidate 5' extension domain having a selected length, sequence, degree of complementarity, or degree of modification, can be evaluated in the system described at Section VII. The candidate 5' extension domain can be placed, either alone, or with one or more other candidate changes in a gRNA molecule/Cas9 molecule system known to be functional with a selected target and evaluated.

In an embodiment, the 5' extension domain has at least 60, 70, 80, 81, 82, 83, 84, 85, 86, 87, 88, 89, 90, 91, 92, 93, 94, 95, 96, 97, 98, 99% homology with, or differs by no more than 1, 2, 3, 4, 5, or 6 nucleotides from, a reference 5' extension domain, e.g., a naturally occurring, e.g., an S. pyogenes, S. aureus or S. thermophilus, 5' extension domain, or a 5' extension domain described herein.

The Linking Domain

In a unimolecular gRNA molecule the linking domain is disposed between the first and second complementarity domains. In a modular gRNA molecule, the two molecules are associated with one another by the complementarity domains.

In an embodiment, the linking domain is 10+/−5, 20+/−5, 30+/−5, 40+/−5, 50+/−5, 60+/−5, 70+/−5, 80+/−5, 90+/−5, or 100+/−5 nucleotides, in length.

In an embodiment, the linking domain is 20+/−10, 30+/−10, 40+/−10, 50+/−10, 60+/−10, 70+/−10, 80+/−10, 90+/−10, or 100+/−10 nucleotides, in length.

In an embodiment, the linking domain is 10 to 100, 10 to 90, 10 to 80, 10 to 70, 10 to 60, 10 to 50, 10 to 40, 10 to 30, 10 to 20 or 10 to 15 nucleotides in length.

In another embodiment, the linking domain is 20 to 100, 20 to 90, 20 to 80, 20 to 70, 20 to 60, 20 to 50, 20 to 40, 20 to 30, or 20 to 25 nucleotides in length.

In an embodiment, the linking domain is 1, 2, 3, 4, 5, 6, 7, 8, 9, 10, 11, 12, 13, 14, 15, 16 17, 18, 19, or 20 nucleotides in length.

In and embodiment, the linking domain is a covalent bond.

In an embodiment, the linking domain comprises a duplexed region, typically adjacent to or within 1, 2, or 3 nucleotides of the 3' end of the first complementarity domain and/or the 5-end of the second complementarity domain. In an embodiment, the duplexed region can be 20+/−10 base pairs in length. In an embodiment, the duplexed region can be 10+/−5, 15+/−5, 20+/−5, or 30+/−5 base pairs in length. In an embodiment, the duplexed region can be 1, 2, 3, 4, 5, 6, 7, 8, 9, 10, 11, 12, 13, 14, or 15 base pairs in length.

Typically the sequences forming the duplexed region have exact complementarity with one another, though in an embodiment as many as 1, 2, 3, 4, 5, 6, 7 or 8 nucleotides are not complementary with the corresponding nucleotides.

In an embodiment, the linking domain nucleotides do not comprise modifications, e.g., modifications of the type provided in Section XI. However, in an embodiment, the linking domain comprises one or more modifications, e.g., modifications that it render it less susceptible to degradation or more bio-compatible, e.g., less immunogenic. By way of example, the backbone of the linking domain can be modified with a phosphorothioate, or other modification(s) from Section XI. In an embodiment a nucleotide of the linking domain can comprise a 2' modification (e.g., a modification at the 2' position on ribose), e.g., a 2-acetylation, e.g., a 2' methylation, or other modification(s) from Section XI. In an embodiment, the linking domain can comprise as many as 1, 2, 3, 4, 5, 6, 7 or 8 modifications.

Modifications in a linking domain can be selected so as to not interfere with targeting efficacy, which can be evaluated by testing a candidate modification in the system described in Section VII. gRNAs having a candidate linking domain having a selected length, sequence, degree of complementarity, or degree of modification, can be evaluated a system described in Section VII. A candidate linking domain can be placed, either alone, or with one or more other candidate changes in a gRNA molecule/Cas9 molecule system known to be functional with a selected target and evaluated.

In an embodiment, the linking domain has at least 60, 70, 80, 81, 82, 83, 84, 85, 86, 87, 88, 89, 90, 91, 92, 93, 94, 95, 96, 97, 98, 99% homology with, or differs by no more than 1, 2, 3, 4, 5, or 6 nucleotides from, a reference linking domain, e.g., a linking domain described herein.

The Proximal Domain

In an embodiment, the proximal domain is 6+/−2, 7+/−2, 8+/−2, 9+/−2, 10+/−2, 11+/−2, 12+/−2, 13+/−2, 14+/−2, 14+/−2, 16+/−2, 17+/−2, 18+/−2, 19+/−2, or 20+/−2 nucleotides in length.

In an embodiment, the proximal domain is 6, 7, 8, 9, 10, 11, 12, 13, 14, 15, 16, 17, 18, 19, 20, 21, 22, 23, 24, 25 or 26 nucleotides in length.

In an embodiment, the proximal domain is 5 to 20, 7, to 18, 9 to 16, or 10 to 14 nucleotides in length.

In an embodiment, the proximal domain nucleotides do not comprise modifications, e.g., modifications of the type provided in Section XI. However, in an embodiment, the proximal domain comprises one or more modifications, e.g., modifications that it render it less susceptible to degradation or more bio-compatible, e.g., less immunogenic. By way of example, the backbone of the proximal domain can be modified with a phosphorothioate, or other modification(s) from Section XI. In an embodiment a nucleotide of the proximal domain can comprise a 2' modification (e.g., a modification at the 2' position on ribose), e.g., a 2-acetylation, e.g., a 2' methylation, or other modification(s) from Section XI.

In an embodiment, the proximal domain can comprise as many as 1, 2, 3, 4, 5, 6, 7 or 8 modifications. In an embodiment, the proximal domain comprises as many as 1, 2, 3, or 4 modifications within 5 nucleotides of its 5' end, e.g., in a modular gRNA molecule. In an embodiment, the target domain comprises as many as 1, 2, 3, or 4 modifications within 5 nucleotides of its 3' end, e.g., in a modular gRNA molecule.

In an embodiment, the proximal domain comprises modifications at two consecutive nucleotides, e.g., two consecutive nucleotides that are within 5 nucleotides of the 5' end of the proximal domain, within 5 nucleotides of the 3' end of the proximal domain, or more than 5 nucleotides away from one or both ends of the proximal domain. In an embodiment, no two consecutive nucleotides are modified within 5 nucleotides of the 5' end of the proximal domain, within 5 nucleotides of the 3' end of the proximal domain, or within a region that is more than 5 nucleotides away from one or both ends of the proximal domain. In an embodiment, no nucleotide is modified within 5 nucleotides of the 5' end of the proximal domain, within 5 nucleotides of the 3' end of the proximal domain, or within a region that is more than 5 nucleotides away from one or both ends of the proximal domain.

Modifications in the proximal domain can be selected so as to not interfere with gRNA molecule efficacy, which can be evaluated by testing a candidate modification in the system described in Section VII. gRNAs having a candidate proximal domain having a selected length, sequence, degree of complementarity, or degree of modification, can be evaluated in the system described at Section VII. The candidate proximal domain can be placed, either alone, or with one or more other candidate changes in a gRNA molecule/Cas9 molecule system known to be functional with a selected target and evaluated.

In an embodiment, the proximal domain has at least 60, 70, 80, 81, 82, 83, 84, 85, 86, 87, 88, 89, 90, 91, 92, 93, 94, 95, 96, 97, 98, 99% homology with, or differs by no more than 1, 2, 3, 4, 5, or 6 nucleotides from, a reference proximal domain, e.g., a naturally occurring, e.g., an *S. pyogenes, S. aureus* or *S. thermophilus*, proximal domain, or a proximal domain described herein.

The Tail Domain

In an embodiment, the tail domain is 10+/−5, 20+/−5, 30+/−5, 40+/−5, 50+/−5, 60+/−5, 70+/−5, 80+/−5, 90+/−5, or 100+/−5 nucleotides, in length.

In an embodiment, the tail domain is 20+/−5 nucleotides in length.

In an embodiment, the tail domain is 20+/−10, 30+/−10, 40+/−10, 50+/−10, 60+/−10, 70+/−10, 80+/−10, 90+/−10, or 100+/−10 nucleotides, in length. In an embodiment, the tail domain is 25+/−10 nucleotides in length.

In an embodiment, the tail domain is 10 to 100, 10 to 90, 10 to 80, 10 to 70, 10 to 60, 10 to 50, 10 to 40, 10 to 30, 10 to 20 or 10 to 15 nucleotides in length.

In another embodiment, the tail domain is 20 to 100, 20 to 90, 20 to 80, 20 to 70, 20 to 60, 20 to 50, 20 to 40, 20 to 30, or 20 to 25 nucleotides in length.

In an embodiment, the tail domain is 1 to 20, 1 to 15, 1 to 10, or 1 to 5 nucleotides in length.

In an embodiment, the tail domain nucleotides do not comprise modifications, e.g., modifications of the type provided in Section XI. However, in an embodiment, the tail domain comprises one or more modifications, e.g., modifications that it render it less susceptible to degradation or more bio-compatible, e.g., less immunogenic. By way of example, the backbone of the tail domain can be modified with a phosphorothioate, or other modification(s) from Section XI. In an embodiment a nucleotide of the tail domain can comprise a 2' modification (e.g., a modification at the 2' position on ribose), e.g., a 2-acetylation, e.g., a 2' methylation, or other modification(s) from Section XI.

In an embodiment, the tail domain can have as many as 1, 2, 3, 4, 5, 6, 7 or 8 modifications. In an embodiment, the target domain comprises as many as 1, 2, 3, or 4 modifications within 5 nucleotides of its 5' end. In an embodiment, the target domain comprises as many as 1, 2, 3, or 4 modifications within 5 nucleotides of its 3' end.

In an embodiment, the tail domain comprises a tail duplex domain, which can form a tail duplexed region. In an embodiment, the tail duplexed region can be 3, 4, 5, 6, 7, 8, 9, 10, 11, or 12 base pairs in length. In an embodiment, a further single stranded domain, exists 3' to the tail duplexed domain. In an embodiment, this domain is 3, 4, 5, 6, 7, 8, 9, or 10 nucleotides in length. In an embodiment it is 4 to 6 nucleotides in length.

In an embodiment, the tail domain has at least 60, 70, 80, 81, 82, 83, 84, 85, 86, 87, 88, 89, 90, 91, 92, 93, 94, 95, 96, 97, 98, 99% homology with, or differs by no more than 1, 2, 3, 4, 5, or 6 nucleotides from, a reference tail domain, e.g., a naturally occurring, e.g., an *S. pyogenes, S. aureus* or *S. thermophilus*, tail domain, or a tail domain described herein.

In an embodiment, the proximal and tail domain, taken together comprise the following sequences:

```
                                        (SEQ ID NO: 96)
AAGGCUAGUCCGUUAUCAACUUGAAAAAGUGGCACCGAGUCGGUGCU,
or
                                        (SEQ ID NO: 97)
AAGGCUAGUCCGUUAUCAACUUGAAAAAGUGGCACCGAGUCGGUGGUGC,
or
                                        (SEQ ID NO: 98)
AAGGCUAGUCCGUUAUCAACUUGAAAAAGUGGCACCGAGUCGGUGCGGAU
C,
or
                                        (SEQ ID NO: 99)
AAGGCUAGUCCGUUAUCAACUUGAAAAAGUG,
or
                                        (SEQ ID NO: 100)
AAGGCUAGUCCGUUAUCA,
or
                                        (SEQ ID NO: 101)
AAGGCUAGUCCG.
```

In an embodiment, the tail domain comprises the 3' sequence UUUUUU, e.g., if a U6 promoter is used for transcription.

In an embodiment, the tail domain comprises the 3' sequence UUUU, e.g., if an H1 promoter is used for transcription.

In an embodiment, tail domain comprises variable numbers of 3' Us depending, e.g., on the termination signal of the pol-III promoter used.

In an embodiment, the tail domain comprises variable 3' sequence derived from the DNA template if a T7 promoter is used.

In an embodiment, the tail domain comprises variable 3' sequence derived from the DNA template, e.g., if in vitro transcription is used to generate the RNA molecule.

In an embodiment, the tail domain comprises variable 3' sequence derived from the DNA template, e.g., if a promoter is used to drive transcription.

Modifications in the tail domain can be selected to not interfere with targeting efficacy, which can be evaluated by testing a candidate modification in the system described in Section VII gRNAs having a candidate tail domain having a selected length, sequence, degree of complementarity, or degree of modification, can be evaluated in the system described in Section VII. The candidate tail domain can be placed, either alone, or with one or more other candidate changes in a gRNA molecule/Cas9 molecule system known to be functional with a selected target and evaluated.

In an embodiment, the tail domain comprises modifications at two consecutive nucleotides, e.g., two consecutive nucleotides that are within 5 nucleotides of the 5' end of the tail domain, within 5 nucleotides of the 3' end of the tail domain, or more than 5 nucleotides away from one or both ends of the tail domain. In an embodiment, no two consecutive nucleotides are modified within 5 nucleotides of the 5' end of the tail domain, within 5 nucleotides of the 3' end of the tail domain, or within a region that is more than 5 nucleotides away from one or both ends of the tail domain. In an embodiment, no nucleotide is modified within 5 nucleotides of the 5' end of the tail domain, within 5 nucleotides of the 3' end of the tail domain, or within a region that is more than 5 nucleotides away from one or both ends of the tail domain.

In an embodiment a gRNA has the following structure:
5' [targeting domain]-[first complementarity domain]-[linking domain]-[second complementarity domain]-[proximal domain]-[tail domain]-3'
wherein, the targeting domain comprises a core domain and optionally a secondary domain, and is 10 to 50 nucleotides in length;
the first complementarity domain is 5 to 25 nucleotides in length and, In an embodiment has at least 50, 60, 70, 80, 81, 82, 83, 84, 85, 86, 87, 88, 89, 90, 91, 92, 93, 94, 95, 96, 97, 98, 99% homology with a reference first complementarity domain disclosed herein;
the linking domain is 1 to 5 nucleotides in length;
the second complementarity domain is 5 to 27 nucleotides in length and, in an embodiment has at least 50, 60, 70, 80, 81, 82, 83, 84, 85, 86, 87, 88, 89, 90, 91, 92, 93, 94, 95, 96, 97, 98, 99% homology with a reference second complementarity domain disclosed herein;
the proximal domain is 5 to 20 nucleotides in length and, in an embodiment has at least 50, 60, 70, 80, 81, 82, 83, 84, 85, 86, 87, 88, 89, 90, 91, 92, 93, 94, 95, 96, 97, 98, 99% homology with a reference proximal domain disclosed herein; and
the tail domain is absent or a nucleotide sequence is 1 to 50 nucleotides in length and, in an embodiment has at least 60, 70, 80, 81, 82, 83, 84, 85, 86, 87, 88, 89, 90, 91, 92, 93, 94, 95, 96, 97, 98, 99% homology with a reference tail domain disclosed herein.

Exemplary Chimeric gRNAs

In an embodiment, a unimolecular, or chimeric, gRNA comprises, preferably from 5' to 3':
a targeting domain (which is complementary to a target nucleic acid);
a first complementarity domain, e.g., comprising 15, 16, 17, 18, 19, 20, 21, 22, 23, 24, 25, or 26 nucleotides;
a linking domain;
a second complementarity domain (which is complementary to the first complementarity domain);
a proximal domain; and
a tail domain,
wherein,
(a) the proximal and tail domain, when taken together, comprise
at least 15, 18, 20, 25, 30, 31, 35, 40, 45, 49, 50, or 53 nucleotides;
(b) there are at least 15, 18, 20, 25, 30, 31, 35, 40, 45, 49, 50, or 53 nucleotides 3' to the last nucleotide of the second complementarity domain; or
(c) there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In an embodiment, the sequence from (a), (b), or (c), has at least 60, 70, 80, 81, 82, 83, 84, 85, 86, 87, 88, 89, 90, 91, 92, 93, 94, 95, 96, 97, 98, 99% homology with the corresponding sequence of a naturally occurring gRNA, or with a gRNA described herein.

In an embodiment, the proximal and tail domain, when taken together, comprise at least 15, 18, 20, 25, 30, 31, 35, 40, 45, 49, 50, or 53 nucleotides.

In an embodiment, there are at least 15, 18, 20, 25, 30, 31, 35, 40, 45, 49, 50, or 53 nucleotides 3' to the last nucleotide of the second complementarity domain.

In an embodiment, there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In an embodiment, the targeting domain comprises, has, or consists of, 16, 17, 18, 19, 20, 21, 22, 23, 24, 25 or 26 nucleotides (e.g., 16, 17, 18, 19, 20, 21, 22, 23, 24, 25 or 26 consecutive nucleotides) having complementarity with the target domain, e.g., the targeting domain is 16, 17, 18, 19, 20, 21, 22, 23, 24, 25, or 26 nucleotides in length.

In an embodiment, the targeting domain comprises, has, or consists of, 16 nucleotides (e.g., 16 consecutive nucleotides) having complementarity with the target domain, e.g., the targeting domain is 16 nucleotides in length.

In an embodiment, the targeting domain comprises, has, or consists of, 17 nucleotides (e.g., 17 consecutive nucleotides) having complementarity with the target domain, e.g., the targeting domain is 17 nucleotides in length.

In an embodiment, the targeting domain comprises, has, or consists of, 18 nucleotides (e.g., 18 consecutive nucleotides) having complementarity with the target domain, e.g., the targeting domain is 18 nucleotides in length.

In an embodiment, the targeting domain comprises, has, or consists of, 19 nucleotides (e.g., 19 consecutive nucleotides) having complementarity with the target domain, e.g., the targeting domain is 19 nucleotides in length.

In an embodiment, the targeting domain comprises, has, or consists of, 20 nucleotides (e.g., 20 consecutive nucleotides) having complementarity with the target domain, e.g., the targeting domain is 20 nucleotides in length.

In an embodiment, the targeting domain comprises, has, or consists of, 21 nucleotides (e.g., 21 consecutive nucleotides) having complementarity with the target domain, e.g., the targeting domain is 21 nucleotides in length.

In an embodiment, the targeting domain comprises, has, or consists of, 22 nucleotides (e.g., 22 consecutive nucleotides) having complementarity with the target domain, e.g., the targeting domain is 22 nucleotides in length.

In an embodiment, the targeting domain comprises, has, or consists of, 23 nucleotides (e.g., 23 consecutive nucleotides) having complementarity with the target domain, e.g., the targeting domain is 23 nucleotides in length.

In an embodiment, the targeting domain comprises, has, or consists of, 24 nucleotides (e.g., 24 consecutive nucleotides) having complementarity with the target domain, e.g., the targeting domain is 24 nucleotides in length.

In an embodiment, the targeting domain comprises, has, or consists of, 25 nucleotides (e.g., 25 consecutive nucleotides) having complementarity with the target domain, e.g., the targeting domain is 25 nucleotides in length.

In an embodiment, the targeting domain comprises, has, or consists of, 26 nucleotides (e.g., 26 consecutive nucleotides) having complementarity with the target domain, e.g., the targeting domain is 26 nucleotides in length.

In an embodiment, the targeting domain comprises, has, or consists of, 16 nucleotides (e.g., 16 consecutive nucleotides) having complementarity with the target domain, e.g., the targeting domain is 16 nucleotides in length; and the proximal and tail domain, when taken together, comprise at least 15, 18, 20, 25, 30, 31, 35, 40, 45, 49, 50, or 53 nucleotides.

In an embodiment, the targeting domain comprises, has, or consists of, 16 nucleotides (e.g., 16 consecutive nucleotides) having complementarity with the target domain, e.g., the targeting domain is 16 nucleotides in length; and there are at least 15, 18, 20, 25, 30, 31, 35, 40, 45, 49, 50, or 53 nucleotides 3' to the last nucleotide of the second complementarity domain.

In an embodiment, the targeting domain comprises, has, or consists of, 16 nucleotides (e.g., 16 consecutive nucleotides) having complementarity with the target domain, e.g., the targeting domain is 16 nucleotides in length; and there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In an embodiment, the targeting domain comprises, has, or consists of, 17 nucleotides (e.g., 17 consecutive nucleotides) having complementarity with the target domain, e.g., the targeting domain is 17 nucleotides in length; and the proximal and tail domain, when taken together, comprise at least 15, 18, 20, 25, 30, 31, 35, 40, 45, 49, 50, or 53 nucleotides.

In an embodiment, the targeting domain comprises, has, or consists of, 17 nucleotides (e.g., 17 consecutive nucleotides) having complementarity with the target domain, e.g., the targeting domain is 17 nucleotides in length; and there are at least 15, 18, 20, 25, 30, 31, 35, 40, 45, 49, 50, or 53 nucleotides 3' to the last nucleotide of the second complementarity domain.

In an embodiment, the targeting domain comprises, has, or consists of, 17 nucleotides (e.g., 17 consecutive nucleotides) having complementarity with the target domain, e.g., the targeting domain is 17 nucleotides in length; and there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In an embodiment, the targeting domain comprises, has, or consists of, 18 nucleotides (e.g., 18 consecutive nucleotides) having complementarity with the target domain, e.g., the targeting domain is 18 nucleotides in length; and the proximal and tail domain, when taken together, comprise at least 15, 18, 20, 25, 30, 31, 35, 40, 45, 49, 50, or 53 nucleotides.

In an embodiment, the targeting domain comprises, has, or consists of, 18 nucleotides (e.g., 18 consecutive nucleotides) having complementarity with the target domain, e.g., the targeting domain is 18 nucleotides in length; and there are at least 15, 18, 20, 25, 30, 31, 35, 40, 45, 49, 50, or 53 nucleotides 3' to the last nucleotide of the second complementarity domain.

In an embodiment, the targeting domain comprises, has, or consists of, 18 nucleotides (e.g., 18 consecutive nucleotides) having complementarity with the target domain, e.g., the targeting domain is 18 nucleotides in length; and there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In an embodiment, the targeting domain comprises, has, or consists of, 19 nucleotides (e.g., 19 consecutive nucleotides) having complementarity with the target domain, e.g., the targeting domain is 19 nucleotides in length; and the proximal and tail domain, when taken together, comprise at least 15, 18, 20, 25, 30, 31, 35, 40, 45, 49, 50, or 53 nucleotides.

In an embodiment, the targeting domain comprises, has, or consists of, 19 nucleotides (e.g., 19 consecutive nucleotides) having complementarity with the target domain, e.g., the targeting domain is 19 nucleotides in length; and there are at least 15, 18, 20, 25, 30, 31, 35, 40, 45, 49, 50, or 53 nucleotides 3' to the last nucleotide of the second complementarity domain.

In an embodiment, the targeting domain comprises, has, or consists of, 19 nucleotides (e.g., 19 consecutive nucleotides) having complementarity with the target domain, e.g., the targeting domain is 19 nucleotides in length; and there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In an embodiment, the targeting domain comprises, has, or consists of, 20 nucleotides (e.g., 20 consecutive nucleotides) having complementarity with the target domain, e.g., the targeting domain is 20 nucleotides in length; and the proximal and tail domain, when taken together, comprise at least 15, 18, 20, 25, 30, 31, 35, 40, 45, 49, 50, or 53 nucleotides.

In an embodiment, the targeting domain comprises, has, or consists of, 20 nucleotides (e.g., 20 consecutive nucleotides) having complementarity with the target domain, e.g., the targeting domain is 20 nucleotides in length; and there are at least 15, 18, 20, 25, 30, 31, 35, 40, 45, 49, 50, or 53 nucleotides 3' to the last nucleotide of the second complementarity domain.

In an embodiment, the targeting domain comprises, has, or consists of, 20 nucleotides (e.g., 20 consecutive nucleotides) having complementarity with the target domain, e.g., the targeting domain is 20 nucleotides in length; and there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In an embodiment, the targeting domain comprises, has, or consists of, 21 nucleotides (e.g., 21 consecutive nucleotides) having complementarity with the target domain, e.g., the targeting domain is 21 nucleotides in length; and the proximal and tail domain, when taken together, comprise at least 15, 18, 20, 25, 30, 31, 35, 40, 45, 49, 50, or 53 nucleotides.

In an embodiment, the targeting domain comprises, has, or consists of, 21 nucleotides (e.g., 21 consecutive nucleotides) having complementarity with the target domain, e.g., the targeting domain is 21 nucleotides in length; and there are at least 15, 18, 20, 25, 30, 31, 35, 40, 45, 49, 50, or 53 nucleotides 3' to the last nucleotide of the second complementarity domain.

In an embodiment, the targeting domain comprises, has, or consists of, 21 nucleotides (e.g., 21 consecutive nucleotides) having complementarity with the target domain, e.g., the targeting domain is 21 nucleotides in length; and there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In an embodiment, the targeting domain comprises, has, or consists of, 22 nucleotides (e.g., 22 consecutive nucleotides) having complementarity with the target domain, e.g., the targeting domain is 22 nucleotides in length; and the proximal and tail domain, when taken together, comprise at least 15, 18, 20, 25, 30, 31, 35, 40, 45, 49, 50, or 53 nucleotides.

In an embodiment, the targeting domain comprises, has, or consists of, 22 nucleotides (e.g., 22 consecutive nucleotides) having complementarity with the target domain, e.g., the targeting domain is 22 nucleotides in length; and there are at least 15, 18, 20, 25, 30, 31, 35, 40, 45, 49, 50, or 53 nucleotides 3' to the last nucleotide of the second complementarity domain.

In an embodiment, the targeting domain comprises, has, or consists of, 22 nucleotides (e.g., 22 consecutive nucleotides) having complementarity with the target domain, e.g., the targeting domain is 22 nucleotides in length; and there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In an embodiment, the targeting domain comprises, has, or consists of, 23 nucleotides (e.g., 23 consecutive nucleotides) having complementarity with the target domain, e.g., the targeting domain is 23 nucleotides in length; and the proximal and tail domain, when taken together, comprise at least 15, 18, 20, 25, 30, 31, 35, 40, 45, 49, 50, or 53 nucleotides.

In an embodiment, the targeting domain comprises, has, or consists of, 23 nucleotides (e.g., 23 consecutive nucleotides) having complementarity with the target domain, e.g., the targeting domain is 23 nucleotides in length; and there are at least 15, 18, 20, 25, 30, 31, 35, 40, 45, 49, 50, or 53 nucleotides 3' to the last nucleotide of the second complementarity domain.

In an embodiment, the targeting domain comprises, has, or consists of, 23 nucleotides (e.g., 23 consecutive nucleotides) having complementarity with the target domain, e.g., the targeting domain is 23 nucleotides in length; and there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In an embodiment, the targeting domain comprises, has, or consists of, 24 nucleotides (e.g., 24 consecutive nucleotides) having complementarity with the target domain, e.g., the targeting domain is 24 nucleotides in length; and the proximal and tail domain, when taken together, comprise at least 15, 18, 20, 25, 30, 31, 35, 40, 45, 49, 50, or 53 nucleotides.

In an embodiment, the targeting domain comprises, has, or consists of, 24 nucleotides (e.g., 24 consecutive nucleotides) having complementarity with the target domain, e.g., the targeting domain is 24 nucleotides in length; and there are at least 15, 18, 20, 25, 30, 31, 35, 40, 45, 49, 50, or 53 nucleotides 3' to the last nucleotide of the second complementarity domain.

In an embodiment, the targeting domain comprises, has, or consists of, 24 nucleotides (e.g., 24 consecutive nucleotides) having complementarity with the target domain, e.g., the targeting domain is 24 nucleotides in length; and there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In an embodiment, the targeting domain comprises, has, or consists of, 25 nucleotides (e.g., 25 consecutive nucleotides) having complementarity with the target domain, e.g., the targeting domain is 25 nucleotides in length; and the proximal and tail domain, when taken together, comprise at least 15, 18, 20, 25, 30, 31, 35, 40, 45, 49, 50, or 53 nucleotides.

In an embodiment, the targeting domain comprises, has, or consists of, 25 nucleotides (e.g., 25 consecutive nucleotides) having complementarity with the target domain, e.g., the targeting domain is 25 nucleotides in length; and there are at least 15, 18, 20, 25, 30, 31, 35, 40, 45, 49, 50, or 53 nucleotides 3' to the last nucleotide of the second complementarity domain.

In an embodiment, the targeting domain comprises, has, or consists of, 25 nucleotides (e.g., 25 consecutive nucleotides) having complementarity with the target domain, e.g., the targeting domain is 25 nucleotides in length; and there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In an embodiment, the targeting domain comprises, has, or consists of, 26 nucleotides (e.g., 26 consecutive nucleotides) having complementarity with the target domain, e.g., the targeting domain is 26 nucleotides in length; and the proximal and tail domain, when taken together, comprise at least 15, 18, 20, 25, 30, 31, 35, 40, 45, 49, 50, or 53 nucleotides.

In an embodiment, the targeting domain comprises, has, or consists of, 26 nucleotides (e.g., 26 consecutive nucleotides) having complementarity with the target domain, e.g., the targeting domain is 26 nucleotides in length; and there are at least 15, 18, 20, 25, 30, 31, 35, 40, 45, 49, 50, or 53 nucleotides 3' to the last nucleotide of the second complementarity domain.

In an embodiment, the targeting domain comprises, has, or consists of, 26 nucleotides (e.g., 26 consecutive nucleotides) having complementarity with the target domain, e.g., the targeting domain is 26 nucleotides in length; and there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In an embodiment, the unimolecular, or chimeric, gRNA molecule (comprising a targeting domain, a first complementary domain, a linking domain, a second complementary domain, a proximal domain and, optionally, a tail domain) comprises the following sequence in which the targeting domain is depicted as 20 Ns but could be any sequence and range in length from 16 to 26 nucleotides and in which the gRNA sequence is followed by 6 Us, which serve as a termination signal for the U6 promoter, but which could be either absent or fewer in number:

(SEQ ID NO: 102)
NNNNNNNNNNNNNNNNNNNNNNGUUUUAGAGCUAGAAAUAGCAAGUUAAAAU

AAGGCUAGUCCGUUAUCAACUUGAAAAAGUGGCACCGAGUCGGUGCUUUU

UU.

In an embodiment, the unimolecular, or chimeric, gRNA molecule is a *S. pyogenes* gRNA molecule.

In some embodiments, the unimolecular, or chimeric, gRNA molecule (comprising a targeting domain, a first complementary domain, a linking domain, a second complementary domain, a proximal domain and, optionally, a tail domain) comprises the following sequence in which the targeting domain is depicted as 20 Ns but could be any sequence and range in length from 16 to 26 nucleotides and in which the gRNA sequence is followed by 6 Us, which serve as a termination signal for the U6 promoter, but which could be either absent or fewer in number:

(SEQ ID NO: 103)
NNNNNNNNNNNNNNNNNNNNGUUUUAGUACUCUGGAAACAGAAUCUACUA

AAACAAGGCAAAAUGCCGUGUUUAUCUCGUCAACUUGUUGGCGAGAUUUU

UU.

In an embodiment, the unimolecular, or chimeric, gRNA molecule is a *S. aureus* gRNA molecule.

Exemplary Modular gRNAs

In an embodiment, a modular gRNA comprises:
a first strand comprising, preferably from 5' to 3';
  a targeting domain, e.g., comprising 15, 16, 17, 18, 19, 20, 21, 22, 23, 24, 25, or 26 nucleotides;
  a first complementarity domain; and
a second strand, comprising, preferably from 5' to 3':
  optionally a 5' extension domain;
  a second complementarity domain;
  a proximal domain; and
  a tail domain,
wherein:
(a) the proximal and tail domain, when taken together, comprise at least 15, 18, 20, 25, 30, 31, 35, 40, 45, 49, 50, or 53 nucleotides;
(b) there are at least 15, 18, 20, 25, 30, 31, 35, 40, 45, 49, 50, or 53 nucleotides 3' to the last nucleotide of the second complementarity domain; or
(c) there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In an embodiment, the sequence from (a), (b), or (c), has at least 60, 75, 80, 85, 90, 95, or 99% homology with the corresponding sequence of a naturally occurring gRNA, or with a gRNA described herein.

In an embodiment, the proximal and tail domain, when taken together, comprise at least 15, 18, 20, 25, 30, 31, 35, 40, 45, 49, 50, or 53 nucleotides.

In an embodiment, there are at least 15, 18, 20, 25, 30, 31, 35, 40, 45, 49, 50, or 53 nucleotides 3' to the last nucleotide of the second complementarity domain.

In an embodiment, there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In an embodiment, the targeting domain comprises, has, or consists of, 16, 17, 18, 19, 20, 21, 22, 23, 24, 25 or 26 nucleotides (e.g., 16, 17, 18, 19, 20, 21, 22, 23, 24, 25 or 26 consecutive nucleotides) having complementarity with the target domain, e.g., the targeting domain is 16, 17, 18, 19, 20, 21, 22, 23, 24, 25 or 26 nucleotides in length.

In an embodiment, the targeting domain comprises, has, or consists of, 16 nucleotides (e.g., 16 consecutive nucleotides) having complementarity with the target domain, e.g., the targeting domain is 16 nucleotides in length.

In an embodiment, the targeting domain comprises, has, or consists of, 17 nucleotides (e.g., 17 consecutive nucleotides) having complementarity with the target domain, e.g., the targeting domain is 17 nucleotides in length.

In an embodiment, the targeting domain comprises, has, or consists of, 18 nucleotides (e.g., 18 consecutive nucleotides) having complementarity with the target domain, e.g., the targeting domain is 18 nucleotides in length.

In an embodiment, the targeting domain comprises, has, or consists of, 19 nucleotides (e.g., 19 consecutive nucleotides) having complementarity with the target domain, e.g., the targeting domain is 19 nucleotides in length.

In an embodiment, the targeting domain comprises, has, or consists of, 20 nucleotides (e.g., 20 consecutive nucleotides) having complementarity with the target domain, e.g., the targeting domain is 20 nucleotides in length.

In an embodiment, the targeting domain comprises, has, or consists of, 21 nucleotides (e.g., 21 consecutive nucleotides) having complementarity with the target domain, e.g., the targeting domain is 21 nucleotides in length.

In an embodiment, the targeting domain comprises, has, or consists of, 22 nucleotides (e.g., 22 consecutive nucleotides) having complementarity with the target domain, e.g., the targeting domain is 22 nucleotides in length.

In an embodiment, the targeting domain comprises, has, or consists of, 23 nucleotides (e.g., 23 consecutive nucleotides) having complementarity with the target domain, e.g., the targeting domain is 23 nucleotides in length.

In an embodiment, the targeting domain comprises, has, or consists of, 24 nucleotides (e.g., 24 consecutive nucleotides) having complementarity with the target domain, e.g., the targeting domain is 24 nucleotides in length.

In an embodiment, the targeting domain comprises, has, or consists of, 25 nucleotides (e.g., 25 consecutive nucleotides) having complementarity with the target domain, e.g., the targeting domain is 5 nucleotides in length.

In an embodiment, the targeting domain comprises, has, or consists of, 26 nucleotides (e.g., 26 consecutive nucleotides) having complementarity with the target domain, e.g., the targeting domain is 26 nucleotides in length.

In an embodiment, the targeting domain comprises, has, or consists of, 16 nucleotides (e.g., 16 consecutive nucleotides) having complementarity with the target domain, e.g., the targeting domain is 16 nucleotides in length; and the proximal and tail domain, when taken together, comprise at least 15, 18, 20, 25, 30, 31, 35, 40, 45, 49, 50, or 53 nucleotides.

In an embodiment, the targeting domain comprises, has, or consists of, 16 nucleotides (e.g., 16 consecutive nucleotides) having complementarity with the target domain, e.g., the targeting domain is 16 nucleotides in length; and there are at least 15, 18, 20, 25, 30, 31, 35, 40, 45, 49, 50, or 53 nucleotides 3' to the last nucleotide of the second complementarity domain.

In an embodiment, the targeting domain comprises, has, or consists of, 16 nucleotides (e.g., 16 consecutive nucleotides) having complementarity with the target domain, e.g., the targeting domain is 16 nucleotides in length; and there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In an embodiment, the targeting domain has, or consists of, 17 nucleotides (e.g., 17 consecutive nucleotides) having complementarity with the target domain, e.g., the targeting domain is 17 nucleotides in length; and the proximal and tail domain, when taken together, comprise at least 15, 18, 20, 25, 30, 31, 35, 40, 45, 49, 50, or 53 nucleotides.

In an embodiment, the targeting domain has, or consists of, 17 nucleotides (e.g., 17 consecutive nucleotides) having complementarity with the target domain, e.g., the targeting domain is 17 nucleotides in length; and there are at least 15, 18, 20, 25, 30, 31, 35, 40, 45, 49, 50, or 53 nucleotides 3' to the last nucleotide of the second complementarity domain.

In an embodiment, the targeting domain has, or consists of, 17 nucleotides (e.g., 17 consecutive nucleotides) having complementarity with the target domain, e.g., the targeting domain is 17 nucleotides in length; and there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In an embodiment, the targeting domain has, or consists of, 18 nucleotides (e.g., 18 consecutive nucleotides) having complementarity with the target domain, e.g., the targeting domain is 18 nucleotides in length; and the proximal and tail domain, when taken together, comprise at least 15, 18, 20, 25, 30, 31, 35, 40, 45, 49, 50, or 53 nucleotides.

In an embodiment, the targeting domain has, or consists of, 18 nucleotides (e.g., 18 consecutive nucleotides) having complementarity with the target domain, e.g., the targeting domain is 18 nucleotides in length; and there are at least 15, 18, 20, 25, 30, 31, 35, 40, 45, 49, 50, or 53 nucleotides 3' to the last nucleotide of the second complementarity domain.

In an embodiment, the targeting domain has, or consists of, 18 nucleotides (e.g., 18 consecutive nucleotides) having complementarity with the target domain, e.g., the targeting domain is 18 nucleotides in length; and there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In an embodiment, the targeting domain comprises, has, or consists of, 19 nucleotides (e.g., 19 consecutive nucleotides) having complementarity with the target domain, e.g., the targeting domain is 19 nucleotides in length; and the proximal and tail domain, when taken together, comprise at least 15, 18, 20, 25, 30, 31, 35, 40, 45, 49, 50, or 53 nucleotides.

In an embodiment, the targeting domain comprises, has, or consists of, 19 nucleotides (e.g., 19 consecutive nucleotides) having complementarity with the target domain, e.g., the targeting domain is 19 nucleotides in length; and there are at least 15, 18, 20, 25, 30, 31, 35, 40, 45, 49, 50, or 53 nucleotides 3' to the last nucleotide of the second complementarity domain.

In an embodiment, the targeting domain comprises, has, or consists of, 19 nucleotides (e.g., 19 consecutive nucleotides) having complementarity with the target domain, e.g., the targeting domain is 19 nucleotides in length; and there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In an embodiment, the targeting domain comprises, has, or consists of, 20 nucleotides (e.g., 20 consecutive nucleotides) having complementarity with the target domain, e.g., the targeting domain is 20 nucleotides in length; and the proximal and tail domain, when taken together, comprise at least 15, 18, 20, 25, 30, 31, 35, 40, 45, 49, 50, or 53 nucleotides.

In an embodiment, the targeting domain comprises, has, or consists of, 20 nucleotides (e.g., 20 consecutive nucleotides) having complementarity with the target domain, e.g., the targeting domain is 20 nucleotides in length; and there are at least 15, 18, 20, 25, 30, 31, 35, 40, 45, 49, 50, or 53 nucleotides 3' to the last nucleotide of the second complementarity domain.

In an embodiment, the targeting domain comprises, has, or consists of, 20 nucleotides (e.g., 20 consecutive nucleotides) having complementarity with the target domain, e.g., the targeting domain is 20 nucleotides in length; and there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In an embodiment, the targeting domain comprises, has, or consists of, 21 nucleotides (e.g., 21 consecutive nucleotides) having complementarity with the target domain, e.g., the targeting domain is 21 nucleotides in length; and the proximal and tail domain, when taken together, comprise at least 15, 18, 20, 25, 30, 31, 35, 40, 45, 49, 50, or 53 nucleotides.

In an embodiment, the targeting domain comprises, has, or consists of, 21 nucleotides (e.g., 21 consecutive nucleotides) having complementarity with the target domain, e.g., the targeting domain is 21 nucleotides in length; and there are at least 15, 18, 20, 25, 30, 31, 35, 40, 45, 49, 50, or 53 nucleotides 3' to the last nucleotide of the second complementarity domain.

In an embodiment, the targeting domain comprises, has, or consists of, 21 nucleotides (e.g., 21 consecutive nucleotides) having complementarity with the target domain, e.g., the targeting domain is 21 nucleotides in length; and there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In an embodiment, the targeting domain comprises, has, or consists of, 22 nucleotides (e.g., 22 consecutive nucleotides) having complementarity with the target domain, e.g., the targeting domain is 22 nucleotides in length; and the proximal and tail domain, when taken together, comprise at least 15, 18, 20, 25, 30, 31, 35, 40, 45, 49, 50, or 53 nucleotides.

In an embodiment, the targeting domain comprises, has, or consists of, 22 nucleotides (e.g., 22 consecutive nucleotides) having complementarity with the target domain, e.g., the targeting domain is 22 nucleotides in length; and there are at least 15, 18, 20, 25, 30, 31, 35, 40, 45, 49, 50, or 53 nucleotides 3' to the last nucleotide of the second complementarity domain.

In an embodiment, the targeting domain comprises, has, or consists of, 22 nucleotides (e.g., 22 consecutive nucleotides) having complementarity with the target domain, e.g., the targeting domain is 22 nucleotides in length; and there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In an embodiment, the targeting domain comprises, has, or consists of, 23 nucleotides (e.g., 23 consecutive nucleotides) having complementarity with the target domain, e.g., the targeting domain is 23 nucleotides in length; and the proximal and tail domain, when taken together, comprise at least 15, 18, 20, 25, 30, 31, 35, 40, 45, 49, 50, or 53 nucleotides.

In an embodiment, the targeting domain comprises, has, or consists of, 23 nucleotides (e.g., 23 consecutive nucleotides) having complementarity with the target domain, e.g., the targeting domain is 23 nucleotides in length; and there are at least 15, 18, 20, 25, 30, 31, 35, 40, 45, 49, 50, or 53 nucleotides 3' to the last nucleotide of the second complementarity domain.

In an embodiment, the targeting domain comprises, has, or consists of, 23 nucleotides (e.g., 23 consecutive nucleotides) having complementarity with the target domain, e.g., the targeting domain is 23 nucleotides in length; and there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In an embodiment, the targeting domain comprises, has, or consists of, 24 nucleotides (e.g., 24 consecutive nucleotides) having complementarity with the target domain, e.g., the targeting domain is 24 nucleotides in length; and the proximal and tail domain, when taken together, comprise at least 15, 18, 20, 25, 30, 31, 35, 40, 45, 49, 50, or 53 nucleotides.

In an embodiment, the targeting domain comprises, has, or consists of, 24 nucleotides (e.g., 24 consecutive nucleotides) having complementarity with the target domain, e.g., the targeting domain is 24 nucleotides in length; and there are at least 15, 18, 20, 25, 30, 31, 35, 40, 45, 49, 50, or 53 nucleotides 3' to the last nucleotide of the second complementarity domain.

In an embodiment, the targeting domain comprises, has, or consists of, 24 nucleotides (e.g., 24 consecutive nucleotides) having complementarity with the target domain, e.g., the targeting domain is 24 nucleotides in length; and there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In an embodiment, the targeting domain comprises, has, or consists of, 25 nucleotides (e.g., 25 consecutive nucleotides) having complementarity with the target domain, e.g., the targeting domain is 25 nucleotides in length; and the proximal and tail domain, when taken together, comprise at least 15, 18, 20, 25, 30, 31, 35, 40, 45, 49, 50, or 53 nucleotides.

In an embodiment, the targeting domain comprises, has, or consists of, 25 nucleotides (e.g., 25 consecutive nucleotides) having complementarity with the target domain, e.g., the targeting domain is 25 nucleotides in length; and there are at least 15, 18, 20, 25, 30, 31, 35, 40, 45, 49, 50, or 53 nucleotides 3' to the last nucleotide of the second complementarity domain.

In an embodiment, the targeting domain comprises, has, or consists of, 25 nucleotides (e.g., 25 consecutive nucleotides) having complementarity with the target domain, e.g., the targeting domain is 25 nucleotides in length; and there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In an embodiment, the targeting domain comprises, has, or consists of, 26 nucleotides (e.g., 26 consecutive nucleotides) having complementarity with the target domain, e.g., the targeting domain is 26 nucleotides in length; and the proximal and tail domain, when taken together, comprise at least 15, 18, 20, 25, 30, 31, 35, 40, 45, 49, 50, or 53 nucleotides.

In an embodiment, the targeting domain comprises, has, or consists of, 26 nucleotides (e.g., 26 consecutive nucleotides) having complementarity with the target domain, e.g., the targeting domain is 26 nucleotides in length; and there are at least 15, 18, 20, 25, 30, 31, 35, 40, 45, 49, 50, or 53 nucleotides 3' to the last nucleotide of the second complementarity domain.

In an embodiment, the targeting domain comprises, has, or consists of, 26 nucleotides (e.g., 26 consecutive nucleotides) having complementarity with the target domain, e.g., the targeting domain is 26 nucleotides in length; and there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain.

In another aspect, methods and compositions discussed herein provide methods and compositions for gene editing by using a gRNA molecule which comprises a polyA tail. In one embodiment, a polyA tail of undefined length ranging from 1 to 1000 nucleotide is added enzymatically using a polymerase such as E. coli polyA polymerase (E-PAP). In one embodiment, the polyA tail of a specified length (e.g., 1, 5, 10, 20, 30, 40, 50, 60, 100, or 150 nucleotides) is encoded on a DNA template and transcribed with the gRNA via an RNA polymerase (e.g., T7 RNA polymerase). In one embodiment, a polyA tail of defined length (e.g., 1, 5, 10, 20, 30, 40, 50, 60, 100, or 150 nucleotides) is synthesized as a synthetic oligonucleotide and ligated on the 3' end of the gRNA with either an RNA ligase or a DNA ligase with our without a splinted DNA oligonucleotide complementary to the guide RNA and the polyA oligonucleotide. In one embodiment, the entire gRNA including a defined length of polyA tail is made synthetically, in one or several pieces, and ligated together by either an RNA ligase or a DNA ligase with or without a splinted DNA oligonucleotide.

Additional exemplary gRNAs for use in the present invention are disclosed in International Application WO 2015/048577, the entire contents of which are expressly incorporated herein by reference

II. Methods for Designing gRNAS

Methods for designing gRNAs are described herein, including methods for selecting, designing and validating target domains. Exemplary targeting domains are also provided herein. Targeting Domains discussed herein can be incorporated into the gRNAs described herein.

Methods for selection and validation of target sequences as well as off-target analyses are described, e.g., in Mali et al., 2013 SCIENCE 339(6121): 823-826; Hsu et al. NAT BIOTECHNOL, 31(9): 827-32; Fu et al., 2014 NAT BIOTECHNOL, doi: 10.1038/nbt.2808. PubMed PMID: 24463574; Heigwer et al., 2014 NAT METHODS 11(2):122-3. doi: 10.1038/nmeth.2812. PubMed PMID: 24481216; Bae et al., 2014 BIOINFORMATICS PubMed PMID: 24463181; Xiao A et al., 2014 BIOINFORMATICS PubMed PMID: 24389662. Additional considerations for designing gRNAs are discussed in the section entitled "gRNA Design" in PCT Application WO 2015/048577, the entire contents of which are expressly incorporated herein by reference.

For example, a software tool can be used to optimize the choice of gRNA within a user's target sequence, e.g., to minimize total off-target activity across the genome. Off target activity may be other than cleavage. For each possible gRNA choice using *S. pyogenes* Cas9, the tool can identify all off-target sequences (preceding either NAG or NGG PAMs) across the genome that contain up to certain number (e.g., 1, 2, 3, 4, 5, 6, 7, 8, 9, or 10) of mismatched base-pairs. The cleavage efficiency at each off-target sequence can be predicted, e.g., using an experimentally-derived weighting scheme. Each possible gRNA is then ranked according to its total predicted off-target cleavage; the top-ranked gRNAs represent those that are likely to have the greatest on-target and the least off-target cleavage. Other functions, e.g., automated reagent design for CRISPR construction, primer design for the on-target Surveyor assay, and primer design for high-throughput detection and quantification of off-target cleavage via next-gen sequencing, can also be included in the tool. Candidate gRNA molecules can be evaluated by art-known methods or as described in Section VII herein.

The targeting domains discussed herein can be incorporated into the gRNAs described herein.

As an example, three strategies are utilized to identify gRNAs for use with *S. pyogenes*, *S. aureus* and *N. meningitidis* Cas9 enzymes.

Guide RNAs (gRNAs) for use with *S. pyogenes*, *S. aureus* and *N. meningitidis* Cas9 molecules are identified using a DNA sequence searching algorithm. Guide RNA design is carried out using a custom guide RNA design software based on the public tool cas-offinder (reference:Cas-OFFinder: a fast and versatile algorithm that searches for potential off-target sites of Cas9 RNA-guided endonucleases, Bioinformatics. 2014 Feb. 17. Bae S, Park J, Kim J S. PMID: 24463181). Said custom guide RNA design software scores guides after calculating their genome-wide off-target propensity. Typically matches ranging from perfect matches to 7 mismatches are considered for guides ranging in length from 17 to 24. Once the off-target sites are computationally determined, an aggregate score is calculated for each guide and summarized in a tabular output using a web-interface. In addition to identifying potential gRNA sites adjacent to PAM sequences, the software also identifies all PAM adjacent sequences that differ by 1, 2, 3 or more nucleotides from the selected gRNA sites. Genomic DNA sequence for each gene was obtained from the UCSC Genome browser and sequences were screened for repeat elements using the publically available RepeatMasker program. RepeatMasker searches input DNA sequences for repeated elements and regions of low complexity. The output is a detailed annotation of the repeats present in a given query sequence.

Following identification, gRNAs are ranked into tiers based on their distance to the target site, their orthogonality and presence of a 5' G (based on identification of close matches in the human genome containing a relevant PAM (e.g., in the case of *S. pyogenes*, a NGG PAM, in the case of *S. aureus*, a NNGRRT (SEQ ID NO: 104) or NNGRRV (SEQ ID NO: 105) PAM, and in the case of *N. meningitidis*, a NNNNGATT (SEQ ID NO: 106) or NNNNGCTT (SEQ ID NO: 107) PAM). Orthogonality refers to the number of sequences in the human genome that contain a minimum number of mismatches to the target sequence. A "high level of orthogonality" or "good orthogonality" may, for example, refer to 20-mer gRNAs that have no identical sequences in the human genome besides the intended target, nor any sequences that contain one or two mismatches in the target sequence. Targeting domains with good orthogonality are selected to minimize off-target DNA cleavage.

gRNAs are identified for both single-gRNA nuclease cleavage and for a dual-gRNA paired "nickase" strategy. Criteria for selecting gRNAs and the determination for which gRNAs can be used for the dual-gRNA paired "nickase" strategy is based on two considerations:

1. gRNA pairs should be oriented on the DNA such that PAMs are facing out and cutting with the D10A Cas9 nickase will result in 5' overhangs.
2. An assumption that cleaving with dual nickase pairs will result in deletion of the entire intervening sequence at a reasonable frequency. However, cleaving with dual nickase pairs can also result in indel mutations at the site of only one of the gRNAs. Candidate pair members can be tested for how efficiently they remove the entire sequence versus causing indel mutations at the site of one gRNA.

The targeting domains discussed herein can be incorporated into the gRNAs described herein.

In an embodiment, two or more (e.g., three or four) gRNA molecules are used with one Cas9 fusion molecule. In another embodiment, when two or more (e.g., three or four) gRNAs are used with two or more Cas9 fusion molecules, at least one Cas9 molecule is from a different species than the other Cas9 molecule(s). For example, when two gRNA molecules are used with two Cas9 fusion molecules, one Cas9 molecule can be from one species and the other Cas9 molecule can be from a different species. Both Cas9 species are used to generate a single or double-strand break, as desired.

Any of the targeting domains in the tables described herein can be used with a Cas9 nickase molecule to generate a single strand break.

Any of the targeting domains in the tables described herein can be used with a Cas9 nuclease molecule to generate a double strand break.

When two gRNAs designed for use to target two Cas9 molecules, one Cas9 can be one species, the second Cas9 can be from a different species. Both Cas9 species are used to generate a single or double-strand break, as desired.

It is contemplated herein that any upstream gRNA described herein may be paired with any downstream gRNA described herein. When an upstream gRNA designed for use with one species of Cas9 is paired with a downstream gRNA designed for use from a different species of Cas9, both Cas9 species are used to generate a single or double-strand break, as desired.

III. Cas9 Molecules

Cas9 molecules of a variety of species can be used in the methods and compositions described herein. While the *S. pyogenes*, *S. aureus*, and *S. thermophilus* Cas9 molecules are the subject of much of the disclosure herein, Cas9 molecules, derived from, or based on the Cas9 proteins of other species listed herein can be used as well. In other words, while the much of the description herein uses *S. pyogenes* and *S. thermophilus* Cas9 molecules, Cas9 molecules from the other species can replace them, e.g., *Staphylococcus aureus* and *Neisseria meningitidis* Cas9 molecules. Additional Cas9 species include: *Acidovorax avenae, Actinobacillus pleuropneumonias, Actinobacillus succinogenes, Actinobacillus suis, Actinomyces* sp., *cycliphilus denitrificans, Aminomonas paucivorans, Bacillus cereus, Bacillus smithii, Bacillus thuringiensis, Bacteroides* sp., *Blastopirellula marina, Bradyrhizobium* sp., *Brevibacillus laterosporus, Campylobacter coli, Campylobacter jejuni, Campylobacter lari, Candidatus puniceispirillum, Clostridium cellulolyti-*

*cum, Clostridium perfringens, Corynebacterium accolens, Corynebacterium diphtheria, Corynebacterium matruchotii, Dinoroseobacter shibae, Eubacterium dolichum, Gamma* proteobacterium, *Gluconacetobacter diazotrophicus, Haemophilus parainfluenzae, Haemophilus sputorum, Helicobacter canadensis, Helicobacter cinaedi, Helicobacter mustelae, Ilyobacter polytropus, Kingella kingae, Lactobacillus crispatus, Listeria ivanovii, Listeria monocytogenes, Listeriaceae bacterium, Methylocystis* sp., *Methylosinus trichosporium, Mobiluncus mulieris, Neisseria bacilliformis, Neisseria cinerea, Neisseria flavescens, Neisseria lactamica, Neisseria* sp., *Neisseria wadsworthii, Nitrosomonas* sp., *Parvibaculum lavamentivorans, Pasteurella multocida, Phascolarctobacterium succinatutens, Ralstonia syzygii, Rhodopseudomonas palustris, Rhodovulum* sp., *Simonsiella muelleri, Sphingomonas* sp., *Sporolactobacillus vineae, Staphylococcus lugdunensis, Streptococcus* sp., *Subdoligranulum* sp., *Tistrella mobilis, Treponema* sp., or *Verminephrobacter eiseniae.*

A Cas9 molecule, or Cas9 polypeptide, as the term is used herein, refers to a molecule or a polypeptide that can interact with a guide RNA (gRNA) molecule) and, in concert with the gRNA molecule, localizes to a site which comprises a target domain, and in some embodiments, a PAM sequence. Cas9 molecule and Cas9 polypeptide, as those terms are used herein, refer to naturally occurring Cas9 molecules and to engineered, altered, or modified Cas9 molecules or Cas9 polypeptides that differ, e.g., by at least one amino acid residue, from a reference sequence, e.g., the most similar naturally occurring Cas9 molecule or a sequence of Table 100.

Cas9 Domains

Crystal structures have been determined for two different naturally occurring bacterial Cas9 molecules (Jinek et al., SCIENCE, 343(6176):1247997, 2014) and for *S. pyogenes* Cas9 with a guide RNA (e.g., a synthetic fusion of crRNA and tracrRNA) (Nishimasu et al., CELL, 156:935-949, 2014; and Anders et al., NATURE, 2014, doi: 10.1038/nature13579).

A naturally occurring Cas9 molecule comprises two lobes: a recognition (REC) lobe and a nuclease (NUC) lobe; each of which further comprise domains described herein. The REC lobe comprises the arginine-rich bridge helix (BH), the REC1 domain, and the REC2 domain. The REC lobe does not share structural similarity with other known proteins, indicating that it is a Cas9-specific functional domain. The BH domain is a long a helix and arginine rich region and comprises amino acids 60-93 of the sequence of *S. pyogenes* Cas9. The REC1 domain is important for recognition of the repeat:anti-repeat duplex, e.g., of a gRNA or a tracrRNA, and is therefore critical for Cas9 activity by recognizing the target sequence. The REC1 domain comprises two REC1 motifs at amino acids 94 to 179 and 308 to 717 of the sequence of *S. pyogenes* Cas9. These two REC1 domains, though separated by the REC2 domain in the linear primary structure, assemble in the tertiary structure to form the REC1 domain. The REC2 domain, or parts thereof, may also play a role in the recognition of the repeat:anti-repeat duplex. The REC2 domain comprises amino acids 180-307 of the sequence of *S. pyogenes* Cas9.

The NUC lobe comprises the RuvC domain, the HNH domain, and the PAM-interacting (PI) domain. The RuvC domain shares structural similarity to retroviral integrase superfamily members and cleaves a single strand, e.g., the non-complementary strand of the target nucleic acid molecule. The RuvC domain is assembled from the three split RuvC motifs (RuvC I, RuvCII, and RuvCIII, which are often commonly referred to in the art as RuvCI domain, or N-terminal RuvC domain, RuvCII domain, and RuvCIII domain) at amino acids 1-59, 718-769, and 909-1098, respectively, of the sequence of *S. pyogenes* Cas9. Similar to the REC1 domain, the three RuvC motifs are linearly separated by other domains in the primary structure, however in the tertiary structure, the three RuvC motifs assemble and form the RuvC domain. The HNH domain shares structural similarity with HNH endonucleases, and cleaves a single strand, e.g., the complementary strand of the target nucleic acid molecule. The HNH domain lies between the RuvC II-III motifs and comprises amino acids 775-908 of the sequence of *S. pyogenes* Cas9. The PI domain interacts with the PAM of the target nucleic acid molecule, and comprises amino acids 1099-1368 of the sequence of *S. pyogenes* Cas9.

A RuvC-Like Domain and an HNH-Like Domain

In an embodiment, a Cas9 molecule or Cas9 polypeptide comprises an HNH-like domain and a RuvC-like domain. In an embodiment, cleavage activity is dependent on a RuvC-like domain and an HNH-like domain. A Cas9 molecule or Cas9 polypeptide, e.g., an eaCas9 molecule or eaCas9 polypeptide, can comprise one or more of the following domains: a RuvC-like domain and an HNH-like domain. In an embodiment, a Cas9 molecule or Cas9 polypeptide is an eaCas9 molecule or eaCas9 polypeptide and the eaCas9 molecule or eaCas9 polypeptide comprises a RuvC-like domain, e.g., a RuvC-like domain described below, and/or an HNH-like domain, e.g., an HNH-like domain described below.

RuvC-Like Domains

In an embodiment, a RuvC-like domain cleaves, a single strand, e.g., the non-complementary strand of the target nucleic acid molecule. The Cas9 molecule or Cas9 polypeptide can include more than one RuvC-like domain (e.g., one, two, three or more RuvC-like domains). In an embodiment, a RuvC-like domain is at least 5, 6, 7, 8 amino acids in length but not more than 20, 19, 18, 17, 16 or 15 amino acids in length. In an embodiment, the Cas9 molecule or Cas9 polypeptide comprises an N-terminal RuvC-like domain of about 10 to 20 amino acids, e.g., about 15 amino acids in length.

N-Terminal RuvC-Like Domains

Some naturally occurring Cas9 molecules comprise more than one RuvC-like domain with cleavage being dependent on the N-terminal RuvC-like domain. Accordingly, Cas9 molecules or Cas9 polypeptide can comprise an N-terminal RuvC-like domain. Exemplary N-terminal RuvC-like domains are described below.

In an embodiment, an eaCas9 molecule or eaCas9 polypeptide comprises an N-terminal RuvC-like domain comprising an amino acid sequence of formula I:

D-X1-G-X2-X3-X4-X5-G-X6-X7-X8-X9     (SEQ ID NO: 108), wherein,
X1 is selected from I, V, M, L and T (e.g., selected from I, V, and L);
X2 is selected from T, I, V, S, N, Y, E and L (e.g., selected from T, V, and I);
X3 is selected from N, S, G, A, D, T, R, M and F (e.g., A or N);
X4 is selected from S, Y, N and F (e.g., S);
X5 is selected from V, I, L, C, T and F (e.g., selected from V, I and L);
X6 is selected from W, F, V, Y, S and L (e.g., W);
X7 is selected from A, S, C, V and G (e.g., selected from A and S);

X8 is selected from V, I, L, A, M and H (e.g., selected from V, I, M and L); and X9 is selected from any amino acid or is absent (e.g., selected from T, V, I, L, Δ, F, S, A, Y, M and R, or, e.g., selected from T, V, I, L and Δ).

In an embodiment, the N-terminal RuvC-like domain differs from a sequence of SEQ ID NO: 108, by as many as 1 but no more than 2, 3, 4, or 5 residues.

In embodiment, the N-terminal RuvC-like domain is cleavage competent.

In embodiment, the N-terminal RuvC-like domain is cleavage incompetent.

In an embodiment, a eaCas9 molecule or eaCas9 polypeptide comprises an N-terminal RuvC-like domain comprising an amino acid sequence of formula II:

D-X1-G-X2-X3-S-X5-G-X6-X7-X8-X9,    (SEQ ID NO: 109), wherein

X1 is selected from I, V, M, L and T (e.g., selected from I, V, and L);

X2 is selected from T, I, V, S, N, Y, E and L (e.g., selected from T, V, and I);

X3 is selected from N, S, G, A, D, T, R, M and F (e.g., A or N);

X5 is selected from V, I, L, C, T and F (e.g., selected from V, I and L);

X6 is selected from W, F, V, Y, S and L (e.g., W);

X7 is selected from A, S, C, V and G (e.g., selected from A and S);

X8 is selected from V, I, L, A, M and H (e.g., selected from V, I, M and L); and X9 is selected from any amino acid or is absent (e.g., selected from T, V, I, L, Δ, F, S, A, Y, M and R or selected from e.g., T, V, I, L and Δ).

In an embodiment, the N-terminal RuvC-like domain differs from a sequence of SEQ ID NO: 109 by as many as 1 but no more than 2, 3, 4, or 5 residues.

In an embodiment, the N-terminal RuvC-like domain comprises an amino acid sequence of formula III:

D-I-G-X2-X3-S-V-G-W-A-X8-X9    (SEQ ID NO: 110), wherein

X2 is selected from T, I, V, S, N, Y, E and L (e.g., selected from T, V, and I);

X3 is selected from N, S, G, A, D, T, R, M and F (e.g., A or N);

X8 is selected from V, I, L, A, M and H (e.g., selected from V, I, M and L); and X9 is selected from any amino acid or is absent (e.g., selected from T, V, I, L, Δ, F, S, A, Y, M and R or selected from e.g., T, V, I, L and Δ).

In an embodiment, the N-terminal RuvC-like domain differs from a sequence of SEQ ID NO:110 by as many as 1 but no more than, 2, 3, 4, or 5 residues.

In an embodiment, the N-terminal RuvC-like domain comprises an amino acid sequence of formula III:

D-I-G-T-N-S-V-G-W-A-V-X    (SEQ ID NO: 111), wherein

X is a non-polar alkyl amino acid or a hydroxyl amino acid, e.g., X is selected from V, I, L and T.

In an embodiment, the N-terminal RuvC-like domain differs from a sequence of SEQ ID NO: 111 by as many as 1 but no more than, 2, 3, 4, or 5 residues.

In an embodiment, the N-terminal RuvC-like domain differs from a sequence of an N-terminal RuvC like domain disclosed herein, as many as 1 but no more than 2, 3, 4, or 5 residues.

Additional RuvC-Like Domains

In addition to the N-terminal RuvC-like domain, the Cas9 molecule or Cas9 polypeptide, e.g., an eaCas9 molecule or eaCas9 polypeptide, can comprise one or more additional RuvC-like domains. In an embodiment, the Cas9 molecule or Cas9 polypeptide can comprise two additional RuvC-like domains. Preferably, the additional RuvC-like domain is at least 5 amino acids in length and, e.g., less than 15 amino acids in length, e.g., 5 to 10 amino acids in length, e.g., 8 amino acids in length.

An additional RuvC-like domain can comprise an amino acid sequence:

I-X1-X2-E-X3-A-R-E    (SEQ ID NO: 112), wherein

X1 is V or H,

X2 is I, L or V (e.g., I or V); and

X3 is M or T.

In an embodiment, the additional RuvC-like domain comprises the amino acid sequence:

I-V-X2-E-M-A-R-E    (SEQ ID NO: 113), wherein

X2 is I, L or V (e.g., I or V).

An additional RuvC-like domain can comprise an amino acid sequence: H-H-A-X1-D-A-X2-X3 (SEQ ID NO: 114), wherein X1 is H or L;

X2 is R or V; and

X3 is E or V.

In an embodiment, the additional RuvC-like domain comprises the amino acid sequence: H-H-A-H-D-A-Y-L (SEQ ID NO:115).

In an embodiment, the additional RuvC-like domain differs from a sequence of SEQ ID NO: 112, 113, 114, 115 by as many as 1 but no more than 2, 3, 4, or 5 residues.

In some embodiments, the sequence flanking the N-terminal RuvC-like domain is a sequences of formula V:

K-X1'-Y-X2'-X3'-X4'-Z-T-D-X9'-Y,    (SEQ ID NO: 116), wherein

X1' is selected from K and P,

X2' is selected from V, L, I, and F (e.g., V, I and L);

X3' is selected from G, A and S (e.g., G),

X4' is selected from L, I, V and F (e.g., L);

X9' is selected from D, E, N and Q; and

Z is an N-terminal RuvC-like domain, e.g., as described above.

HNH-Like Domains

In an embodiment, an HNH-like domain cleaves a single stranded complementary domain, e.g., a complementary strand of a double stranded nucleic acid molecule. In an embodiment, an HNH-like domain is at least 15, 20, 25 amino acids in length but not more than 40, 35 or 30 amino acids in length, e.g., 20 to 35 amino acids in length, e.g., 25 to 30 amino acids in length. Exemplary HNH-like domains are described below.

In an embodiment, an eaCas9 molecule or eaCas9 polypeptide comprises an HNH-like domain having an amino acid sequence of formula VI:

X1-X2-X3-H-X4-X5-P-X6-X7-X8-X9-X10-X11-X12-X13-X14-X15-N-X16-X17-X18-X19-X20-X21-X22-X23-N(SEQ ID NO: 117), wherein X1 is selected from D, E, Q and N (e.g., D and E);

X2 is selected from L, I, R, Q, V, M and K;

X3 is selected from D and E;

X4 is selected from I, V, T, A and L (e.g., A, I and V);

X5 is selected from V, Y, I, L, F and W (e.g., V, I and L);

X6 is selected from Q, H, R, K, Y, I, L, F and W;

X7 is selected from S, A, D, T and K (e.g., S and A);
X8 is selected from F, L, V, K, Y, M, I, R, A, E, D and Q (e.g., F);
X9 is selected from L, R, T, I, V, S, C, Y, K, F and G;
X10 is selected from K, Q, Y, T, F, L, W, M, A, E, G, and S;
X11 is selected from D, S, N, R, L and T (e.g., D);
X12 is selected from D, N and S;
X13 is selected from S, A, T, G and R (e.g., S);
X14 is selected from I, L, F, S, R, Y, Q, W, D, K and H (e.g., I, L and F);
X15 is selected from D, S, I, N, E, A, H, F, L, Q, M, G, Y and V;
X16 is selected from K, L, R, M, T and F (e.g., L, R and K);
X17 is selected from V, L, I, A and T;
X18 is selected from L, I, V and A (e.g., L and I);
X19 is selected from T, V, C, E, S and A (e.g., T and V);
X20 is selected from R, F, T, W, E, L, N, C, K, V, S, Q, I, Y, H and A;
X21 is selected from S, P, R, K, N, A, H, Q, G and L;
X22 is selected from D, G, T, N, S, K, A, I, E, L, Q, R and Y; and
X23 is selected from K, V, A, E, Y, I, C, L, S, T, G, K, M, D and F.

In an embodiment, a HNH-like domain differs from a sequence of SEQ ID NO: 117 by at least one but no more than, 2, 3, 4, or 5 residues.

In an embodiment, the HNH-like domain is cleavage competent.

In an embodiment, the HNH-like domain is cleavage incompetent.

In an embodiment, an eaCas9 molecule or eaCas9 polypeptide comprises an HNH-like domain comprising an amino acid sequence of formula VII:

X1-X2-X3-H-X4-X5-P-X6-S-X8-X9-X10-D-D-S-
X14-X15-N-K-V-L-X19-X20-X21-X22-X23-N (SEQ ID NO: 118), wherein
X1 is selected from D and E;
X2 is selected from L, I, R, Q, V, M and K;
X3 is selected from D and E;
X4 is selected from I, V, T, A and L (e.g., A, I and V);
X5 is selected from V, Y, I, L, F and W (e.g., V, I and L);
X6 is selected from Q, H, R, K, Y, I, L, F and W;
X8 is selected from F, L, V, K, Y, M, I, R, A, E, D and Q (e.g., F);
X9 is selected from L, R, T, I, V, S, C, Y, K, F and G;
X10 is selected from K, Q, Y, T, F, L, W, M, A, E, G, and S;
X14 is selected from I, L, F, S, R, Y, Q, W, D, K and H (e.g., I, L and F);
X15 is selected from D, S, I, N, E, A, H, F, L, Q, M, G, Y and V;
X19 is selected from T, V, C, E, S and A (e.g., T and V);
X20 is selected from R, F, T, W, E, L, N, C, K, V, S, Q, I, Y, H and A;
X21 is selected from S, P, R, K, N, A, H, Q, G and L;
X22 is selected from D, G, T, N, S, K, A, I, E, L, Q, R and Y; and
X23 is selected from K, V, A, E, Y, I, C, L, S, T, G, K, M, D and F.

In an embodiment, the HNH-like domain differs from a sequence of SEQ ID NO: 118 by 1, 2, 3, 4, or 5 residues.

In an embodiment, an eaCas9 molecule or eaCas9 polypeptide comprises an HNH-like domain comprising an amino acid sequence of formula VII:

X1-V-X3-H-I-V-P X6-S-X8-X9-X10-D-D-S-X14-
X15-N-K-V-L-T-X20-X21-X22-X23-N (SEQ ID NO: 119), wherein
X1 is selected from D and E;
X3 is selected from D and E;
X6 is selected from Q, H, R, K, Y, I, L and W;
X8 is selected from F, L, V, K, Y, M, I, R, A, E, D and Q (e.g., F);
X9 is selected from L, R, T, I, V, S, C, Y, K, F and G;
X10 is selected from K, Q, Y, T, F, L, W, M, A, E, G, and S;
X14 is selected from I, L, F, S, R, Y, Q, W, D, K and H (e.g., I, L and F);
X15 is selected from D, S, I, N, E, A, H, F, L, Q, M, G, Y and V;
X20 is selected from R, F, T, W, E, L, N, C, K, V, S, Q, I, Y, H and A;
X21 is selected from S, P, R, K, N, A, H, Q, G and L;
X22 is selected from D, G, T, N, S, K, A, I, E, L, Q, R and Y; and
X23 is selected from K, V, A, E, Y, I, C, L, S, T, G, K, M, D and F.

In an embodiment, the HNH-like domain differs from a sequence of SEQ ID NO: 119 by 1, 2, 3, 4, or 5 residues.

In an embodiment, an eaCas9 molecule or eaCas9 polypeptide comprises an HNH-like domain having an amino acid sequence of formula VIII:

D-X2-D-I-X5-P-Q-X7-F-X9-X10-D-X12-S-I-D-N-
X16-V-L-X19-X20-S-X22-X23-N (SEQ ID NO: 118), wherein
X2 is selected from I and V;
X5 is selected from I and V;
X7 is selected from A and S;
X9 is selected from I and L;
X10 is selected from K and T;
X12 is selected from D and N;
X16 is selected from R, K and L; X19 is selected from T and V;
X20 is selected from S and R;
X22 is selected from K, D and A; and
X23 is selected from E, K, G and N (e.g., the eaCas9 molecule or eaCas9 polypeptide can comprise an HNH-like domain as described herein).

In an embodiment, the HNH-like domain differs from a sequence of SEQ ID NO: 120 by as many as 1 but no more than 2, 3, 4, or 5 residues.

In an embodiment, an eaCas9 molecule or eaCas9 polypeptide comprises the amino acid sequence of formula IX:

L-Y-Y-L-Q-N-G-X1'-D-M-Y-X2'-X3'-X4'-X5'-L-D-I-
X6'-X7'-L-S-X8'-Y-Z-N-R-X9'-K-X10'-D-X11'-
V-P (SEQ ID NO: 121), wherein
X1' is selected from K and R;
X2' is selected from V and T;
X3' is selected from G and D;
X4' is selected from E, Q and D;
X5' is selected from E and D;
X6' is selected from D, N and H;
X7' is selected from Y, R and N;
X8' is selected from Q, D and N; X9' is selected from G and E;

X10' is selected from S and G;

X11' is selected from D and N; and

Z is an HNH-like domain, e.g., as described above.

In an embodiment, the eaCas9 molecule or eaCas9 polypeptide comprises an amino acid sequence that differs from a sequence of SEQ ID NO: 121 by as many as 1 but no more than 2, 3, 4, or 5 residues.

In an embodiment, the HNH-like domain differs from a sequence of an HNH-like domain disclosed herein, by as many as 1 but no more than 2, 3, 4, or 5 residues.

In an embodiment, the HNH-like domain differs from a sequence of an HNH-like domain disclosed herein, by as many as 1 but no more than 2, 3, 4, or 5 residues.

Cas9 Activities

Nuclease and Helicase Activities

In an embodiment, the Cas9 molecule or Cas9 polypeptide is capable of cleaving a target nucleic acid molecule. Typically wild type Cas9 molecules cleave both strands of a target nucleic acid molecule. Cas9 molecules and Cas9 polypeptides can be engineered to alter nuclease cleavage (or other properties), e.g., to provide a Cas9 molecule or Cas9 polypeptide which is a nickase, or which lacks the ability to cleave target nucleic acid. A Cas9 molecule or Cas9 polypeptide that is capable of cleaving a target nucleic acid molecule is referred to herein as an eaCas9 (an enzymatically active Cas9) molecule or eaCas9 polypeptide.

In an embodiment, an eaCas9 molecule or eaCas9 polypeptide comprises one or more of the following enzymatic activities:

a nickase activity, i.e., the ability to cleave a single strand, e.g., the non-complementary strand or the complementary strand, of a nucleic acid molecule;

a double stranded nuclease activity, i.e., the ability to cleave both strands of a double stranded nucleic acid and create a double stranded break, which in an embodiment is the presence of two nickase activities;

an endonuclease activity;

an exonuclease activity; and a helicase activity, i.e., the ability to unwind the helical structure of a double stranded nucleic acid.

In an embodiment, an enzymatically active or an eaCas9 molecule or eaCas9 polypeptide cleaves both DNA strands and results in a double stranded break. In an embodiment, an eaCas9 molecule or eaCas9 polypeptide cleaves only one strand, e.g., the strand to which the gRNA hybridizes to, or the strand complementary to the strand the gRNA hybridizes with. In an embodiment, an eaCas9 molecule or eaCas9 polypeptide comprises cleavage activity associated with an HNH domain. In an embodiment, an eaCas9 molecule or eaCas9 polypeptide comprises cleavage activity associated with a RuvC domain. In an embodiment, an eaCas9 molecule or eaCas9 polypeptide comprises cleavage activity associated with an HNH domain and cleavage activity associated with a RuvC domain. In an embodiment, an eaCas9 molecule or eaCas9 polypeptide comprises an active, or cleavage competent, HNH domain and an inactive, or cleavage incompetent, RuvC domain. In an embodiment, an eaCas9 molecule or eaCas9 polypeptide comprises an inactive, or cleavage incompetent, HNH domain and an active, or cleavage competent, RuvC domain.

Some Cas9 molecules or Cas9 polypeptides have the ability to interact with a gRNA molecule, and in conjunction with the gRNA molecule localize to a core target domain, but are incapable of cleaving the target nucleic acid, or incapable of cleaving at efficient rates. Cas9 molecules having no, or no substantial, cleavage activity are referred to herein as an eiCas9 molecule or eiCas9 polypeptide. For example, an eiCas9 molecule or eiCas9 polypeptide can lack cleavage activity or have substantially less, e.g., less than 20, 10, 5, 1 or 0.1% of the cleavage activity of a reference Cas9 molecule or eiCas9 polypeptide, as measured by an assay described herein.

Targeting and PAMs

A Cas9 molecule or Cas9 polypeptide, is a polypeptide that can interact with a guide RNA (gRNA) molecule and, in concert with the gRNA molecule, localizes to a site which comprises a target domain, and in an embodiment, a PAM sequence.

In an embodiment, the ability of an eaCas9 molecule or eaCas9 polypeptide to interact with and cleave a target nucleic acid is PAM sequence dependent. A PAM sequence is a sequence in the target nucleic acid. In an embodiment, cleavage of the target nucleic acid occurs upstream from the PAM sequence. EaCas9 molecules from different bacterial species can recognize different sequence motifs (e.g., PAM sequences). In an embodiment, an eaCas9 molecule of S. pyogenes recognizes the sequence motif NGG and directs cleavage of a target nucleic acid sequence 1 to 10, e.g., 3 to 5, base pairs upstream from that sequence. See, e.g., Mali et al., SCIENCE (2013) 339(6121): 823-826. In an embodiment, an eaCas9 molecule of S. thermophilus recognizes the sequence motif NGGNG (SEQ ID NO.: 122) and/or NNAGAAW (W=A or T) (SEQ ID NO.: 123) and directs cleavage of a target nucleic acid sequence 1 to 10, e.g., 3 to 5, base pairs upstream from these sequences. See, e.g., Horvath et al., SCIENCE (2010); 327(5962):167-170, and Deveau et al., J. BACTERIOL. 2008; 190(4): 1390-1400. In an embodiment, an eaCas9 molecule of S. mutans recognizes the sequence motif NGG and/or NAAR (R=A or G) (SEQ ID NO.: 124) and directs cleavage of a target nucleic acid sequence 1 to 10, e.g., 3 to 5 base pairs, upstream from this sequence. See, e.g., Deveau et al., J BACTERIOL 2008; 190(4): 1390-1400. In an embodiment, an eaCas9 molecule of S. aureus recognizes the sequence motif NNGRR (R=A or G) (SEQ ID NO.: 125) and directs cleavage of a target nucleic acid sequence 1 to 10, e.g., 3 to 5, base pairs upstream from that sequence. In an embodiment, an eaCas9 molecule of S. aureus recognizes the sequence motif NNGRRN (R=A or G)(SEQ ID NO: 126) and directs cleavage of a target nucleic acid sequence 1 to 10, e.g., 3 to 5, base pairs upstream from that sequence. In an embodiment, an eaCas9 molecule of S. aureus recognizes the sequence motif NNGRRT (R=A or G)(SEQ ID NO: 104) and directs cleavage of a target nucleic acid sequence 1 to 10, e.g., 3 to 5, base pairs upstream from that sequence. In an embodiment, an eaCas9 molecule of S. aureus recognizes the sequence motif NNGRRV (R=A or G) (SEQ ID NO.: 105) and directs cleavage of a target nucleic acid sequence 1 to 10, e.g., 3 to 5, base pairs upstream from that sequence. In an embodiment, an eaCas9 molecule of N. meningitidis recognizes the sequence motif NNNNGATT (SEQ ID NO.: 106) or NNNGCTT (R=A or G) (SEQ ID NO: 127) and directs cleavage of a target nucleic acid sequence 1 to 10, e.g., 3 to 5, base pairs upstream from that sequence. See, e.g., Hou et al. (2013) PROC. NAT'L. ACAD. SCI. USA 110(39):15644-15649. The ability of a Cas9 molecule to recognize a PAM sequence can be determined, e.g., using a transformation assay described in Jinek et al. (2012) SCIENCE 337:816. In the aforementioned embodiments, N can be any nucleotide residue, e.g., any of A, G, C or T.

As is discussed herein, Cas9 molecules can be engineered to alter the PAM specificity of the Cas9 molecule.

Exemplary naturally occurring Cas9 molecules are described in Chylinski et al. (2013) RNA BIOLOGY 10:5, 727-737. Such Cas9 molecules include Cas9 molecules of a cluster 1 bacterial family, cluster 2 bacterial family, cluster 3 bacterial family, cluster 4 bacterial family, cluster 5 bacterial family, cluster 6 bacterial family, a cluster 7 bacterial family, a cluster 8 bacterial family, a cluster 9 bacterial family, a cluster 10 bacterial family, a cluster 11 bacterial family, a cluster 12 bacterial family, a cluster 13 bacterial family, a cluster 14 bacterial family, a cluster 15 bacterial family, a cluster 16 bacterial family, a cluster 17 bacterial family, a cluster 18 bacterial family, a cluster 19 bacterial family, a cluster 20 bacterial family, a cluster 21 bacterial family, a cluster 22 bacterial family, a cluster 23 bacterial family, a cluster 24 bacterial family, a cluster 25 bacterial family, a cluster 26 bacterial family, a cluster 27 bacterial family, a cluster 28 bacterial family, a cluster 29 bacterial family, a cluster 30 bacterial family, a cluster 31 bacterial family, a cluster 32 bacterial family, a cluster 33 bacterial family, a cluster 34 bacterial family, a cluster 35 bacterial family, a cluster 36 bacterial family, a cluster 37 bacterial family, a cluster 38 bacterial family, a cluster 39 bacterial family, a cluster 40 bacterial family, a cluster 41 bacterial family, a cluster 42 bacterial family, a cluster 43 bacterial family, a cluster 44 bacterial family, a cluster 45 bacterial family, a cluster 46 bacterial family, a cluster 47 bacterial family, a cluster 48 bacterial family, a cluster 49 bacterial family, a cluster 50 bacterial family, a cluster 51 bacterial family, a cluster 52 bacterial family, a cluster 53 bacterial family, a cluster 54 bacterial family, a cluster 55 bacterial family, a cluster 56 bacterial family, a cluster 57 bacterial family, a cluster 58 bacterial family, a cluster 59 bacterial family, a cluster 60 bacterial family, a cluster 61 bacterial family, a cluster 62 bacterial family, a cluster 63 bacterial family, a cluster 64 bacterial family, a cluster 65 bacterial family, a cluster 66 bacterial family, a cluster 67 bacterial family, a cluster 68 bacterial family, a cluster 69 bacterial family, a cluster 70 bacterial family, a cluster 71 bacterial family, a cluster 72 bacterial family, a cluster 73 bacterial family, a cluster 74 bacterial family, a cluster 75 bacterial family, a cluster 76 bacterial family, a cluster 77 bacterial family, or a cluster 78 bacterial family.

Exemplary naturally occurring Cas9 molecules include a Cas9 molecule of a cluster 1 bacterial family. Examples include a Cas9 molecule of *S. pyogenes* (e.g., strain SF370, MGAS10270, MGAS10750, MGAS2096, MGAS315, MGAS5005, MGAS6180, MGAS9429, NZ131 and SSI-1), *S. thermophilus* (e.g., strain LIVID-9), *S. pseudoporcinus* (e.g., strain SPIN 20026), *S. mutans* (e.g., strain UA159, NN2025), *S. macacae* (e.g., strain NCTC11558), *S. gallolyticus* (e.g., strain UCN34, ATCC BAA-2069), *S. equines* (e.g., strain ATCC 9812, MGCS 124), *S. dysdalactiae* (e.g., strain GGS 124), *S. bovis* (e.g., strain ATCC 700338), *S. anginosus* (e.g., strain F0211), *S. agalactiae* (e.g., strain NEM316, A909), *Listeria monocytogenes* (e.g., strain F6854), *Listeria innocua* (*L. innocua*, e.g., strain Clip11262), *Enterococcus italicus* (e.g., strain DSM 15952), or *Enterococcus faecium* (e.g., strain 1,231,408). Additional exemplary Cas9 molecules are a Cas9 molecule of *Neisseria meningitidis* (Hou et al., PNAS Early Edition 2013, 1-6 and a *S. aureus* cas9 molecule.

In an embodiment, a Cas9 molecule or Cas9 polypeptide, e.g., an eaCas9 molecule or eaCas9 polypeptide, comprises an amino acid sequence:

having 60%, 65%, 70%, 75%, 80%, 81%, 82%, 83%, 84%, 85%, 86%, 87%, 88%, 89%, 90%, 91%, 92%, 93%, 94%, 95%, 96%, 97%, 98% or 99% homology with;

differs at no more than, 2, 5, 10, 15, 20, 30, or 40% of the amino acid residues when compared with;

differs by at least 1, 2, 3, 4, 5, 6, 7, 8, 9, 10, 11, 12, 13, 14, 15, 16, 17, 18, 19, 20 amino acids, but by no more than 100, 80, 70, 60, 50, 40 or 30 amino acids from; or is identical to any Cas9 molecule sequence described herein, or a naturally occurring Cas9 molecule sequence, e.g., a Cas9 molecule from a species listed herein or described in Chylinski et al. (2013) RNA BIOLOGY 10:5, 727-737; Hou et al., PNAS Early Edition 2013, 1-6. In an embodiment, the Cas9 molecule or Cas9 polypeptide comprises one or more of the following activities: a nickase activity; a double stranded cleavage activity (e.g., an endonuclease and/or exonuclease activity); a helicase activity; or the ability, together with a gRNA molecule, to localize to a target nucleic acid.

Engineered or Altered Cas9 Molecules and Cas9 Polypeptides

Cas9 molecules and Cas9 polypeptides described herein, e.g., naturally occurring Cas9 molecules, can possess any of a number of properties, including: nuclease activity (e.g., endonuclease and/or exonuclease activity); helicase activity; the ability to associate functionally with a gRNA molecule; and the ability to target (or localize to) a site on a nucleic acid (e.g., PAM recognition and specificity). In an embodiment, a Cas9 molecule or Cas9 polypeptide can include all or a subset of these properties. In a typical embodiment, a Cas9 molecule or Cas9 polypeptide has the ability to interact with a gRNA molecule and, in concert with the gRNA molecule, localize to a site in a nucleic acid. Other activities, e.g., PAM specificity, cleavage activity, or helicase activity can vary more widely in Cas9 molecules and Cas9 polypeptides.

Cas9 molecules include engineered Cas9 molecules and engineered Cas9 polypeptides (engineered, as used in this context, means merely that the Cas9 molecule or Cas9 polypeptide differs from a reference sequences, and implies no process or origin limitation). An engineered Cas9 molecule or Cas9 polypeptide can comprise altered enzymatic properties, e.g., altered nuclease activity (as compared with a naturally occurring or other reference Cas9 molecule) or altered helicase activity. As discussed herein, an engineered Cas9 molecule or Cas9 polypeptide can have nickase activity (as opposed to double strand nuclease activity). In an embodiment an engineered Cas9 molecule or Cas9 polypeptide can have an alteration that alters its size, e.g., a deletion of amino acid sequence that reduces its size, e.g., without significant effect on one or more, or any Cas9 activity. In an embodiment, an engineered Cas9 molecule or Cas9 polypeptide can comprise an alteration that affects PAM recognition. For example, an engineered Cas9 molecule can be altered to recognize a PAM sequence other than that recognized by the endogenous wild-type PI domain. In an embodiment a Cas9 molecule or Cas9 polypeptide can differ in sequence from a naturally occurring Cas9 molecule but not have significant alteration in one or more Cas9 activities.

Cas9 molecules or Cas9 polypeptides with desired properties can be made in a number of ways, e.g., by alteration of a parental, e.g., naturally occurring Cas9 molecule or Cas9 polypeptide, to provide an altered Cas9 molecule or Cas9 polypeptide having a desired property. For example, one or more mutations or differences relative to a parental Cas9 molecule, e.g., a naturally occurring or engineered Cas9 molecule, can be introduced. Such mutations and differences comprise: substitutions (e.g., conservative substitutions or substitutions of non-essential amino acids), insertions, or deletions. In an embodiment, a Cas9 molecule or Cas9 polypeptide can comprises one or more mutations or differences, e.g., at least 1, 2, 3, 4, 5, 10, 15, 20, 30, 40 or 50 mutations but less than 200, 100, or 80 mutations relative to a reference, e.g., a parental Cas9 molecule.

In an embodiment, a mutation or mutations do not have a substantial effect on a Cas9 activity, e.g. a Cas9 activity described herein. In an embodiment, a mutation or mutations have a substantial effect on a Cas9 activity, e.g. a Cas9 activity described herein.

Non-Cleaving and Modified-Cleavage Cas9 Molecules and Cas9 Polypeptides

In an embodiment, a Cas9 molecule or Cas9 polypeptide comprises a cleavage property that differs from naturally occurring Cas9 molecules, e.g., that differs from the naturally occurring Cas9 molecule having the closest homology. For example, a Cas9 molecule or Cas9 polypeptide can differ from a naturally occurring Cas9 molecule, e.g., a Cas9 molecule of *S. pyogenes*, as follows: its ability to modulate, e.g., decreased or increased, cleavage of a double stranded nucleic acid (endonuclease and/or exonuclease activity), e.g., as compared to a naturally occurring Cas9 molecule (e.g., a Cas9 molecule of *S. pyogenes*); its ability to modulate, e.g., decreased or increased, cleavage of a single strand of a nucleic acid, e.g., a non-complementary strand of a nucleic acid molecule or a complementary strand of a nucleic acid molecule (nickase activity), e.g., as compared to a naturally occurring Cas9 molecule (e.g., a Cas9 molecule of *S. pyogenes*); or the ability to cleave a nucleic acid molecule, e.g., a double stranded or single stranded nucleic acid molecule, can be eliminated.

Alterations in the Ability to Cleave One or Both Strands of a Target Nucleic Acid In an embodiment, exemplary Cas9 activities comprise one or more of PAM specificity, cleavage activity, and helicase activity. A mutation(s) can be present, e.g., in: one or more RuvC domains, e.g., an N-terminal RuvC domain; an HNH domain; a region outside the RuvC domains and the HNH domain. In an embodiment, a mutation(s) is present in a RuvC domain. In an embodiment, a mutation(s) is present in an HNH domain. In an embodiment, mutations are present in both a RuvC domain and an HNH domain.

Exemplary mutations that may be made in the RuvC domain or HNH domain with reference to the *S. pyogenes* Cas9 sequence include: D10A, E762A, H840A, N854A, N863A and/or D986A. Exemplary mutations that may be made in the RuvC domain with reference to the *S. aureus* Cas9 sequence include: N580A.

In an embodiment, a Cas9 molecule is an eiCas9 molecule comprising one or more differences in a RuvC domain and/or in an HNH domain as compared to a reference Cas9 molecule, and the eiCas9 molecule does not cleave a nucleic acid, or cleaves with significantly less efficiency than does wild type, e.g., when compared with wild type in a cleavage assay, e.g., as described herein, cuts with less than 50, 25, 10, or 1% of a reference Cas9 molecule, as measured by an assay described herein.

Whether or not a particular sequence, e.g., a substitution, may affect one or more activity, such as targeting activity, cleavage activity, etc., can be evaluated or predicted, e.g., by evaluating whether the mutation is conservative. In an embodiment, a "non-essential" amino acid residue, as used in the context of a Cas9 molecule, is a residue that can be altered from the wild-type sequence of a Cas9 molecule, e.g., a naturally occurring Cas9 molecule, e.g., an eaCas9 molecule, without abolishing or more preferably, without substantially altering a Cas9 activity (e.g., cleavage activity), whereas changing an "essential" amino acid residue results in a substantial loss of activity (e.g., cleavage activity).

In an embodiment, a Cas9 molecule comprises a cleavage property that differs from naturally occurring Cas9 molecules, e.g., that differs from the naturally occurring Cas9 molecule having the closest homology. For example, a Cas9 molecule can differ from naturally occurring Cas9 molecules, e.g., a Cas9 molecule of *S. aureus*, *S. pyogenes*, or *C. jejuni* as follows: its ability to modulate, e.g., decreased or increased, cleavage of a double stranded break (endonuclease and/or exonuclease activity), e.g., as compared to a naturally occurring Cas9 molecule (e.g., a Cas9 molecule of *S. aureus*, *S. pyogenes*, or *C. jejuni*); its ability to modulate, e.g., decreased or increased, cleavage of a single strand of a nucleic acid, e.g., a non-complimentary strand of a nucleic acid molecule or a complementary strand of a nucleic acid molecule (nickase activity), e.g., as compared to a naturally occurring Cas9 molecule (e.g., a Cas9 molecule of *S. aureus*, *S. pyogenes*, or *C. jejuni*); or the ability to cleave a nucleic acid molecule, e.g., a double stranded or single stranded nucleic acid molecule, can be eliminated.

In an embodiment, the altered Cas9 molecule is an eaCas9 molecule comprising one or more of the following activities: cleavage activity associated with a RuvC domain; cleavage activity associated with an HNH domain; cleavage activity associated with an HNH domain and cleavage activity associated with a RuvC domain.

In an embodiment, the altered Cas9 molecule is an eiCas9 molecule which does not cleave a nucleic acid molecule (either double stranded or single stranded nucleic acid molecules) or cleaves a nucleic acid molecule with significantly less efficiency, e.g., less than 20, 10, 5, 1 or 0.1% of the cleavage activity of a reference Cas9 molecule, e.g., as measured by an assay described herein. The reference Cas9 molecule can be a naturally occurring unmodified Cas9 molecule, e.g., a naturally occurring Cas9 molecule such as a Cas9 molecule of *S. pyogenes*, *S. thermophilus*, *S. aureus*, *C. jejuni* or *N. meningitidis*. In an embodiment, the reference Cas9 molecule is the naturally occurring Cas9 molecule having the closest sequence identity or homology. In an embodiment, the eiCas9 molecule lacks substantial cleavage activity associated with a RuvC domain and cleavage activity associated with an HNH domain.

In an embodiment, the altered Cas9 molecule or Cas9 polypeptide, e.g., an eaCas9 molecule or eaCas9 polypeptide, can be a fusion, e.g., of two of more different Cas9 molecules, e.g., of two or more naturally occurring Cas9 molecules of different species. For example, a fragment of a naturally occurring Cas9 molecule of one species can be fused to a fragment of a Cas9 molecule of a second species. As an example, a fragment of a Cas9 molecule of *S. pyogenes* comprising an N-terminal RuvC-like domain can be fused to a fragment of Cas9 molecule of a species other than *S. pyogenes* (e.g., *S. thermophilus*) comprising an HNH-like domain.

Cas9 Molecules with Altered PAM Recognition or No PAM Recognition

Naturally occurring Cas9 molecules can recognize specific PAM sequences, for example the PAM recognition sequences described above for, e.g., *S. pyogenes*, *S. thermophilus*, *S. mutans*, *S. aureus* and *N. meningitidis*.

In an embodiment, a Cas9 molecule or Cas9 polypeptide has the same PAM specificities as a naturally occurring Cas9 molecule. In an embodiment, a Cas9 molecule or Cas9 polypeptide has a PAM specificity not associated with a naturally occurring Cas9 molecule, or a PAM specificity not associated with the naturally occurring Cas9 molecule to which it has the closest sequence homology. For example, a naturally occurring Cas9 molecule can be altered, e.g., to alter PAM recognition, e.g., to alter the PAM sequence that the Cas9 molecule or Cas9 polypeptide recognizes to decrease off target sites and/or improve specificity; or eliminate a PAM recognition requirement. In an embodiment, a Cas9 molecule or Cas9 polypeptide can be altered, e.g., to increase length of PAM recognition sequence and/or improve Cas9 specificity to high level of identity (e.g., 98%, 99% or 100% match between gRNA and a PAM sequence), e.g., to decrease off target sites and increase specificity. In an embodiment, the length of the PAM recognition sequence is at least 4, 5, 6, 7, 8, 9, 10 or 15 amino acids in length. In an embodiment, the Cas9 specificity requires at least 90%, 95%, 96%, 97%, 98%, 99% or more homology between the gRNA and the PAM sequence. Cas9 molecules or Cas9 polypeptides that recognize different PAM sequences and/or have reduced off-target activity can be generated using directed evolution. Exemplary methods and systems that can be used for directed evolution of Cas9 molecules are described, e.g., in Esvelt et al. (2011) NATURE 472(7344): 499-503. Candidate Cas9 molecules can be evaluated, e.g., by methods described in Section VII.

Alterations of the PI domain, which mediates PAM recognition are discussed below.

Synthetic Cas9 Molecules and Cas9 Polypeptides with Altered PI Domains

Current genome-editing methods are limited in the diversity of target sequences that can be targeted by the PAM sequence that is recognized by the Cas9 molecule utilized. A synthetic Cas9 molecule (or Syn-Cas9 molecule), or synthetic Cas9 polypeptide (or syn-Cas9 polypeptide), as that term is used herein, refers to a Cas9 molecule or Cas9 polypeptide that comprises a Cas9 core domain from one bacterial species and a functional altered PI domain, i.e., a PI domain other than that naturally associated with the Cas9 core domain, e.g., from a different bacterial species.

In an embodiment, the altered PI domain recognizes a PAM sequence that is different from the PAM sequence recognized by the naturally-occurring Cas9 from which the Cas9 core domain is derived. In an embodiment, the altered PI domain recognizes the same PAM sequence recognized by the naturally-occurring Cas9 from which the Cas9 core domain is derived, but with different affinity or specificity. A Syn-Cas9 molecule or Syn-Cas9 polypeptide can be, respectively, a Syn-eaCas9 molecule or Syn-eaCas9 polypeptide or a Syn-eiCas9 molecule Syn-eiCas9 polypeptide.

An exemplary Syn-Cas9 molecule Syn-Cas9 polypeptide comprises:
  a) a Cas9 core domain, e.g., a Cas9 core domain from Table 100 or 200, e.g., a *S. aureus, S. pyogenes*, or *C. jejuni* Cas9 core domain; and
  b) an altered PI domain from a species X Cas9 sequence selected from Tables 400 and 500.

In an embodiment, the RKR motif (the PAM binding motif) of said altered PI domain comprises: differences at 1, 2, or 3 amino acid residues; a difference in amino acid sequence at the first, second, or third position; differences in amino acid sequence at the first and second positions, the first and third positions, or the second and third positions; as compared with the sequence of the RKR motif of the native or endogenous PI domain associated with the Cas9 core domain.

In an embodiment, the Cas9 core domain comprises the Cas9 core domain from a species X Cas9 from Table 100 and said altered PI domain comprises a PI domain from a species Y Cas9 from Table 100.

In an embodiment, the RKR motif of the species X Cas9 is other than the RKR motif of the species Y Cas9.

In an embodiment, the RKR motif of the altered PI domain is selected from XXY, XNG, and XNQ.

In an embodiment, the altered PI domain has at least 60, 70, 80, 81, 82, 83, 84, 85, 86, 87, 88, 89, 90, 91, 92, 93, 94, 95, 96, 97, 98, 99 or 100% homology with the amino acid sequence of a naturally occurring PI domain of said species Y from Table 100.

In an embodiment, the altered PI domain differs by no more than 50, 40, 30, 25, 20, 19, 18, 17, 16, 15, 14, 13, 12, 11, 10, 9, 8, 7, 6, 5, 4, 3, 2, or 1 amino acid residue from the amino acid sequence of a naturally occurring PI domain of said second species from Table 100.

In an embodiment, the Cas9 core domain comprises a *S. aureus* core domain and altered PI domain comprises: an *A. denitrificans* PI domain; a *C. jejuni* PI domain; a *H. mustelae* PI domain; or an altered PI domain of species X PI domain, wherein species X is selected from Table 400 or Table 500.

In an embodiment, the Cas9 core domain comprises a *S. pyogenes* core domain and the altered PI domain comprises: an *A. denitrificans* PI domain; a *C. jejuni* PI domain; a *H. mustelae* PI domain; or an altered PI domain of species X PI domain, wherein species X is selected from Table 400 or Table 500.

In an embodiment, the Cas9 core domain comprises a *C. jejuni* core domain and the altered PI domain comprises: an *A. denitrificans* PI domain; a *H. mustelae* PI domain; or an altered PI domain of species X PI domain, wherein species X is selected from Table 400 or Table 500.

In an embodiment, the Cas9 molecule further comprises a linker disposed between said Cas9 core domain and said altered PI domain.

In an embodiment, the linker comprises: a linker described elsewhere herein disposed between the Cas9 core domain and the heterologous PI domain.

Exemplary altered PI domains for use in Syn-Cas9 molecules are described in Tables 400 and 500. The sequences for the 83 Cas9 orthologs referenced in Tables 400 and 500 are provided in Table 100. Table 250 provides the Cas9 orthologs with known PAM sequences and the corresponding RKR motif.

In an embodiment, a Syn-Cas9 molecule may also be size-optimized, e.g., the Syn-Cas9 molecule comprises one or more deletions, and optionally one or more linkers disposed between the amino acid residues flanking the deletions. In an embodiment, a Syn-Cas9 molecule comprises a REC deletion.

Size-Optimized Cas9 Molecules

Engineered Cas9 molecules and engineered Cas9 polypeptides, as described herein, include a Cas9 molecule or Cas9 polypeptide comprising a deletion that reduces the size of the molecule while still retaining desired Cas9 properties, e.g., essentially native conformation, Cas9 nuclease activity, and/or target nucleic acid molecule recognition. Provided herein are Cas9 molecules or Cas9 polypeptides comprising one or more deletions, and optionally one or more linkers, wherein a linker is disposed between the amino acid residues that flank the deletion. Methods for identifying suitable deletions in a reference Cas9 molecule, methods for generating Cas9 molecules with a deletion and a linker, and methods for using such Cas9 molecules will be apparent to one of ordinary skill in the art upon review of this document.

A Cas9 molecule, e.g., a *S. aureus*, *S. pyogenes*, or *C. jejuni*, Cas9 molecule, having a deletion is smaller, e.g., has reduced number of amino acids, than the corresponding naturally-occurring Cas9 molecule. The smaller size of the Cas9 molecules allows increased flexibility for delivery methods, and thereby increases utility for genome-editing. A Cas9 molecule can comprise one or more deletions that do not substantially affect or decrease the activity of the resultant Cas9 molecules described herein. Activities that are retained in the Cas9 molecules comprising a deletion as described herein include one or more of the following:

a nickase activity, i.e., the ability to cleave a single strand, e.g., the non-complementary strand or the complementary strand, of a nucleic acid molecule; a double stranded nuclease activity, i.e., the ability to cleave both strands of a double stranded nucleic acid and create a double stranded break, which in an embodiment is the presence of two nickase activities;

an endonuclease activity;

an exonuclease activity;

a helicase activity, i.e., the ability to unwind the helical structure of a double stranded nucleic acid;

and recognition activity of a nucleic acid molecule, e.g., a target nucleic acid or a gRNA.

Activity of the Cas9 molecules described herein can be assessed using the activity assays described herein or in the art.

Identifying Regions Suitable for Deletion

Suitable regions of Cas9 molecules for deletion can be identified by a variety of methods. Naturally-occurring orthologous Cas9 molecules from various bacterial species, e.g., any one of those listed in Table 100, can be modeled onto the crystal structure of *S. pyogenes* Cas9 (Nishimasu et al. (2014) CELL, 156: 935-949) to examine the level of conservation across the selected Cas9 orthologs with respect to the three-dimensional conformation of the protein. Less conserved or unconserved regions that are located spatially distant from regions involved in Cas9 activity, e.g., the interface with a target nucleic acid molecule and/or gRNA, represent regions or domains that are candidates for deletion without substantially affecting or decreasing Cas9 activity.

REC-Optimized Cas9 Molecules

A REC-optimized Cas9 molecule, as that term is used herein, refers to a Cas9 molecule that comprises a deletion in one or both of the REC2 domain and the $REl_{CT}$ domain (collectively a REC deletion), wherein the deletion comprises at least 10% of the amino acid residues in the cognate domain. A REC-optimized Cas9 molecule can be an eaCas9 molecule or an eiCas9 molecule. An exemplary REC-optimized Cas9 molecule comprises:

a) a deletion selected from:
  i) a REC2 deletion;
  ii) a $REC1_{CT}$ deletion; or
  iii) a $REC1_{SUB}$ deletion.

Optionally, a linker is disposed between the amino acid residues that flank the deletion. In an embodiment a Cas9 molecule includes only one deletion, or only two deletions. A Cas9 molecule can comprise a REC2 deletion and a $REC1_{CT}$ deletion. A Cas9 molecule can comprise a REC2 deletion and a $REC1_{SUB}$ deletion.

Generally, the deletion will contain at least 10% of the amino acids in the cognate domain, e.g., a REC2 deletion will include at least 10% of the amino acids in the REC2 domain. A deletion can comprise: at least 10, 20, 30, 40, 50, 60, 70, 80, or 90% of the amino acid residues of its cognate domain; all of the amino acid residues of its cognate domain; an amino acid residue outside its cognate domain; a plurality of amino acid residues outside its cognate domain; the amino acid residue immediately N terminal to its cognate domain; the amino acid residue immediately C terminal to its cognate domain; the amino acid residue immediately N terminal to its cognate and the amino acid residue immediately C terminal to its cognate domain; a plurality of, e.g., up to 5, 10, 15, or 20, amino acid residues N terminal to its cognate domain; a plurality of e.g., up to 5, 10, 15, or 20, amino acid residues C terminal to its cognate domain; a plurality of, e.g., up to 5, 10, 15, or 20, amino acid residues N terminal to its cognate domain and a plurality of e.g., up to 5, 10, 15, or 20, amino acid residues C terminal to its cognate domain.

In an embodiment, a deletion does not extend beyond: its cognate domain; the N terminal amino acid residue of its cognate domain; the C terminal amino acid residue of its cognate domain.

A REC-optimized Cas9 molecule can include a linker disposed between the amino acid residues that flank the deletion. Linkers for use in generating recombinant proteins, e.g., multi-domain proteins, are known in the art (Chen et al. (2013) ADV. DRUG DELIVERY REV. 65:1357-69). Any linkers known in the art that maintain the conformation or native fold of the Cas9 molecule (thereby retaining Cas9 activity) can be used. Several properties of linkers, such as length, hydrophobicity, intrinsic properties of the amino acids residues themselves, and secondary structure should be considered in the context of the goal to maintain native conformation and functional activity of Cas9. Any linkers known in the art that maintain the conformation or native fold of the Cas9 molecule (thereby retaining Cas9 activity) can be used. Several properties of linkers, such as length, hydrophobicity, intrinsic properties of the amino acids residues themselves, and secondary structure should be considered in the context of the goal to maintain native conformation and functional activity of Cas9.

A flexible linker can be utilized in the Cas9 molecules described herein. Flexible linkers allow a certain degree of movement and/or interaction within and between the joined domains or regions of the protein. Generally, flexible linkers are composed of small, non-polar (e.g., Gly) or polar (e.g., Ser or Thr) amino acids. The small size of these amino acids provides flexibility and allows mobility of the connected domains or regions. Furthermore, the incorporation of Ser or Thr can help maintain the stability of the linker in aqueous solutions by hydrogen bonding with the water molecules, thereby reducing unfavorable interactions between the linker and the other protein moieties. Commonly used flexible linkers are comprised of sequences that primarily consist of Gly and Ser residues. Often, these flexible linkers consist of repeating units of a combination of Gly and Ser residues, e.g., $(GGS)_x$, where the number of repeating units, e.g., x, can be optimized to achieve the appropriate separation of other domains or regions of the protein.

In some cases, a rigid linker may be preferred if there is significant distance between the joined domains or regions, or to maintain a fixed distance between the joined domains or regions of a protein and independent functions of the domains/regions. Rigid linkers often have defined secondary structure, e.g., alpha helix, or other stabilizing interactions, e.g., salt bridges and disulfide bonds. Rigid linkers commonly contain multiple Pro residues, or repeating combinations of Glu-Pro or Lys-Pro because Pro imposes a strong conformation constraint due to its structure.

The linker can comprise an amino acid residue, e.g., 1, 2, 3, 4, 5, 6, 7, 8, 9, or 10 amino acid residues. Typically, the linker will comprises less than 10, 20 or 30 amino acid residues. Typically, the linker is less than 50, 40, 30, 20, 10, or 5% of the length of the deleted sequence. Suitable linkers include: [Gly-Ser]$_x$, wherein x is 1, 2, 3, 4, 5, 6, 7, 8, 9, or 10 (SEQ ID NO: 128); [Gly-Gly-Ser]$_x$, wherein x is 1, 2, 3, 4, 5, 6, 7, 8, 9, or 10 (SEQ ID NO: 129); [Gly-Gly-Ser]; [Gly-Ser-Gly-Ser]$_x$, wherein x is 1, 2, 3, 4, or 5 (SEQ ID NO: 130); [Gly-Ser-Gly-Ser] (SEQ ID NO: 131); (GSAGSAAGSGFF)$_x$, wherein x is 1, 2, 3 or 4 (SEQ ID NO: 132); (SIVAQLSRPDPA)$_x$, wherein x is 1, 2, 3 or 4 (SEQ ID NO: 133); or an XTEN sequence, e.g., the XTEN sequence of SEQ ID NO: #_____, or a sequence that differs therefrom by no more than 1, 2, 3, 4, 5, 6, 7, 8, 9 or 10 amino acid residues. In an embodiment linker comprises an amino acid sequence other than a sequence within REC2.

In an embodiment, a REC-optimized Cas9 molecule comprises an amino acid sequence that, other than any REC deletion and associated linker, has at least 50, 55, 60, 65, 70, 75, 80, 81, 82, 83, 84, 85, 86, 87, 88, 89, 90, 91, 92, 93, 94, 95, 96, 97, 98, 99, or 100% homology with the amino acid sequence of a naturally occurring Cas9, e.g., a Cas9 molecule described in Table 100, e.g., a *S. aureus* Cas9 molecule, a *S. pyogenes* Cas9 molecule, or a *C. jejuni* Cas9 molecule.

In an embodiment, a REC-optimized Cas9 molecule comprises an amino acid sequence that, other than any REC deletion and associated linker, differs by no more than 1, 2, 3, 4, 5, 6, 7, 8, 9, 10, 11, 12, 13, 14, 15, 16, 17, 18, 19, 20, 21, 22, 23, 24, or 25 amino acid residues from the amino acid sequence of a naturally occurring Cas9, e.g., a Cas9 molecule described in Table 100, e.g., a *S. aureus* Cas9 molecule, a *S. pyogenes* Cas9 molecule, or a *C. jejuni* Cas9 molecule.

In an embodiment, a REC-optimized Cas9 molecule comprises an amino acid sequence that, other than any REC deletion and associate linker, differs by no more than 1, 2, 3, 4, 5, 6, 7, 8, 9, 10, 11, 12, 13, 14, 15, 16, 17, 18, 19, 20, 21, 22, 23, 24, or 25% of the amino acid residues from the amino acid sequence of a naturally occurring Cas9, e.g., a Cas9 molecule described in Table 100, e.g., a *S. aureus* Cas9 molecule, a *S. pyogenes* Cas9 molecule, or a *C. jejuni* Cas9 molecule.

For sequence comparison, typically one sequence acts as a reference sequence, to which test sequences are compared. When using a sequence comparison algorithm, test and reference sequences are entered into a computer, subsequence coordinates are designated, if necessary, and sequence algorithm program parameters are designated. Default program parameters can be used, or alternative parameters can be designated. The sequence comparison algorithm then calculates the percent sequence identities for the test sequences relative to the reference sequence, based on the program parameters. Methods of alignment of sequences for comparison are well known in the art. Optimal alignment of sequences for comparison can be conducted, e.g., by the local homology algorithm of Smith and Waterman (1970) ADV. APPL. MATH. 2: 482c, by the homology alignment algorithm of Needleman and Wunsch, (1970) J. MOL. BIOL. 48:443, by the search for similarity method of Pearson and Lipman, (1988) PROC. NAT'L. ACAD. SCI. USA 85:2444, by computerized implementations of these algorithms (GAP, BESTFIT, FASTA, and TFASTA in the Wisconsin Genetics Software Package, Genetics Computer Group, 575 Science Dr., Madison, Wis.), or by manual alignment and visual inspection (see, e.g., Brent et al., (2003) CURRENT PROTOCOLS IN MOLECULAR BIOLOGY).

Two examples of algorithms that are suitable for determining percent sequence identity and sequence similarity are the BLAST and BLAST 2.0 algorithms, which are described in Altschul et al. (1977) NUC. ACIDS RES. 25:3389-3402; and Altschul et al. (1990) J. MOL. BIOL. 215: 403-410, respectively. Software for performing BLAST analyses is publicly available through the National Center for Biotechnology Information.

The percent identity between two amino acid sequences can also be determined using the algorithm of E. Meyers and W. Miller (1988) COMPUT. APPL. BIOSCI. 4:11-17, which has been incorporated into the ALIGN program (version 2.0), using a PAM120 weight residue table, a gap length penalty of 12 and a gap penalty of 4. In addition, the percent identity between two amino acid sequences can be determined using the Needleman and Wunsch (1970) J. MOL. BIOL. 48:444-453 algorithm which has been incorporated into the GAP program in the GCG software package (available at www.gcg.com), using either a Blossom 62 matrix or a PAM250 matrix, and a gap weight of 16, 14, 12, 10, 8, 6, or 4 and a length weight of 1, 2, 3, 4, 5, or 6.

Sequence information for exemplary REC deletions are provided for 83 naturally-occurring Cas9 orthologs in Table 100.

The amino acid sequences of exemplary Cas9 molecules from different bacterial species are shown below.

TABLE 100

Amino Acid Sequence of Cas9 Orthologs

| Species/ Composite ID | Amino acid sequence | REC2 | | | REC1$_{CT}$ | | | Rec$_{sub}$ | | |
| --- | --- | --- | --- | --- | --- | --- | --- | --- | --- | --- |
| | | start (AA pos) | stop (AA pos) | # AA deleted (n) | start (AA pos) | stop (AA pos) | # AA deleted (n) | start (AA pos) | stop (AA pos) | # AA deleted (n) |
| *Staphylococcus aureus* tr\|J7RUA5\| J7RUA5_STAAU | MKRNYILGLDIGITSVGYGIID YETRDVIDAGVRLFKEANVENN EGRRSKRGARRLKRRRRHRIQR VKKLLFDYNLLTDHSELSGINP YEARVKGLSQKLSEEEFSAALL HLAKRRGVHNVNEVEEDTGNEL STKEQISRNSKALEEKYVAELQ LERLKKDGEVRGSINRFKTSDY VKEAKQLLKVQKAYHQLDQSFI DTYIDLLETRRTYYEGPGEGSP FGWKDIKEWYEMLMGHCTYFPE ELRSVKYAYNADLYNALNDLNN | 126 | 166 | 41 | 296 | 352 | 57 | 296 | 352 | 57 |

TABLE 100-continued

Amino Acid Sequence of Cas9 Orthologs

| Species/ Composite ID | Amino acid sequence | REC2 start (AA pos) | REC2 stop (AA pos) | REC2 # AA deleted (n) | REC1_CT start (AA pos) | REC1_CT stop (AA pos) | REC1_CT # AA deleted (n) | Rec_sub start (AA pos) | Rec_sub stop (AA pos) | Rec_sub # AA deleted (n) |
|---|---|---|---|---|---|---|---|---|---|---|
| | LVITRDENEKLEYYEKFQIIEN VFKQKKKPTLKQIAKEILVNEE DIKGYRVTSTGKPEFTNLKVYH DIKDITARKEIIENAELLDQIA KILTIYQSSEDIQEELTNLNSE LTQEEIEQISNLKGYTGTHNLS LKAINLILDELWHTNDNQIAIF NRLKLVPKKVDLSQQKEIPTTL VDDFILSPVVKRSFIQSIKVIN AIIKKYGLPNDIIIELAREKNS KDAQKMINEMQKRNRQTNERIE EIIRTTGKENAKYLIEKIKLHD MQEGKCLYSLEAIPLEDLLNNP FNYEVDHIIPRSVSFDNSFNNK VLVKQEENSKKGNRTPFQYLSS SDSKISYETFKKHILNLAKGKG RISKTKKEYLLEERDINRFSVQ KDFINRNLVDTRYATRGLMNLL RSYFRVNNLDVKVKSINGGFTS FLRRKWKFKKERNKGYKHHAED ALIIANADFIFKEWKKLDKAKK VMENQMFEEKQAESMPEIETEQ EYKEIFITPHQIKHIKDFKDYK YSHRVDKKPNRELINDTLYSTR KDDKGNTLIVNNLNGLYDKDND KLKKLINKSPEKLLMYHHDPQT YQKLKLIMEQYGDEKNPLYKYY EETGNYLTKYSKKDNGPVIKKI KYYGNKLNAHLDITDDYPNSRN KVVKLSLKPYRFDVYLDNGVYK FVTVKNLDVIKKENYYEVNSKC YEEAKKLKKISNQAEFIASFYN NDLIKINGELYRVIGVNNDLLN RIEVNMIDITYREYLENMNDKR PPRIIKTIASKTQSIKKYSTDI LGNLYEVSKKHPQIIKKG (SEQ ID NO: 6) | | | | | | | | | | |
| Streptococcus pyogenes sp\|Q99ZW2\| CAS9_STRP1 | MDKKYSIGLDIGTNSVGWAVIT DEYKVPSKKFKVLGNTDRHSIK KNLIGALLFDSGETAEATRLKR TARRRYTRRKNRICYLQEIFSN EMAKVDDSFFHRLEESFLVEED KKHERHPIFGNIVDEVAYHEKY PTIYHLRKKLVDSTDKADLRLI YLALAHMIKFRGHFLIEGDLNP DNSDVDKLFIQLVQTYNQLFEE NPINASGVDAKAILSARLSKSR RLENLIAQLPGEKKNGLFGNLI ALSLGLTPNFKSNFDLAEDAKL QLSKDTYDDDLDNLLAQIGDQY ADLFLAAKNLSDAILLSDILRV NTEITKAPLSASMIKRYDEHHQ DLTLLKALVRQQLPEKYKEIFF DQSKNGYAGYIDGGASQEEFYK FIKPILEKMDGTEELLVKLNRE DLLRKQRTFDNGSIPHQIHLGE LHAILRRQEDFYPFLKDNREKI EKILTFRIPYYVGPLARGNSRF AWMTRKSEETITPWNFEEVVDK GASAQSFIERMTNFDKNLPNEK VLPKHSLLYEYFTVYNELTKVK YVTEGMRKPAFLSGEQKKAIVD LLFKTNRKVTVKQLKEDYFKKI ECFDSVEISGVEDRFNASLGTY HDLLKIIKDKDFLDNEENEDIL EDIVLTLTLFEDREMIEERLKT YAHLFDDKVMKQLKRRRYTGWG RLSRKLINGIRDKQSGKTILDF LKSDGFANRNFMQLIHDDSLTF KEDIQKAQVSGQGDSLHEHIAN LAGSPAIKKGILQTVKVVDELV | 176 | 314 | 139 | 511 | 592 | 82 | 511 | 592 | 82 |

TABLE 100-continued

Amino Acid Sequence of Cas9 Orthologs

| Species/ Composite ID | Amino acid sequence | REC2 start (AA pos) | REC2 stop (AA pos) | REC2 # AA deleted (n) | REC1$_{CT}$ start (AA pos) | REC1$_{CT}$ stop (AA pos) | REC1$_{CT}$ # AA deleted (n) | Rec$_{sub}$ start (AA pos) | Rec$_{sub}$ stop (AA pos) | Rec$_{sub}$ # AA deleted (n) |
|---|---|---|---|---|---|---|---|---|---|---|
| | KVMGRHKPENIVIEMARENQTT QKGQKNSRERMKRIEEGIKELG SQILKEHPVENTQLQNEKLYLY YLQNGRDMYVDQELDINRLSDY DVDHIVPQSFLKDDSIDNKVLT RSDKNRGKSDNVPSEEVVKKMK NYWRQLLNAKLITQRKFDNLTK AERGGLSELDKAGFIKRQLVET RQITKHVAQILDSRMNTKYDEN DKLIREVKVITLKSKLVSDFRK DFQFYKVREINNYHHAHDAYLN AVVGTALIKKYPKLESEFVYGD YKVYDVRKMIAKSEQEIGKATA KYFFYSNIMNFFKTEITLANGE IRKRPLIETNGETGEIVWDKGR DFATVRKVLSMPQVNIVKKTEV QTGGFSKESILPKRNSDKLIAR KKDWDPKKYGGFDSPTVAYSVL VVAKVEKGKSKKLKSVKELLGI TIMERSSFEKNPIDFLEAKGYK EVKKDLIIKLPKYSLFELENGR KRMLASAGELQKGNELALPSKY VNFLYLASHYEKLKGSPEDNEQ KQLFVEQHKHYLDEIIEQISEF SKRVILADANLDKVLSAYNKHR DKPIREQAENIIHLFTLTNLGA PAAFKYFDTTIDRKRYTSTKEV LDATLIHQSITGLYETRIDLSQ LGGD (SEQ ID NO: 7) | | | | | | | | | | |
| Campylobacter jejuni NCTC 11168 gi\|218563121\| ref\| YP_002344900.1 | MARILAFDIGISSIGWAFSEND ELKDCGVRIFTKVENPKTGESL ALPRRLARSARKRLARRKARLN HLKHLIANEFKLNYEDYQSFDE SLAKAYKGSLISPYELRFRALN ELLSKQDFARVILHIAKRRGYD DIKNSDDKEKGAILKAIKQNEE KLANYQSVGEYLYKEYFQKFKE NSKEFTNVRNKKESYERCIAQS FLKDELKLIFKKQREFGFSFSK KFEEEVLSVAFYKRALKDFSHL VGNCSFFTDEKRAPKNSPLAFM FVALTRIINLLNNLKNTEGILY TKDDLNALLNEVLKNGTLTYKQ TKKLLGLSDDYEFKGEKGTYFI EFKKYKEFIKALGEHNLSQDDL NEIAKDITLIKDEIKLKKALAK YDLNQNQIDSLSKLEFKDHLNI SFKALKLVTPLMLEGKKYDEAC NELNLKVAINEDKKDFLPAFNE TYYKDEVTNPVVLRAIKEYRKV LNALLKKYGKVHKINIELAREV GKNHSQRAKIEKEQNENYKAKK DAELECEKLGLKINSKNILKLR LFKEQKEFCAYSGEKIKISDLQ DEKMLEIDHIYPYSRSFDDSYM NKVLVFTKQNQEKLNQTPFEAF GNDSAKWQKIEVLAKNLPTKKQ KRILDKNYKDKEQKNFKDRNLN DTRYIARLVLNYTKDYLDFLPL SDDENTKLNDTQKGSKVHVEAK SGMLTSALRHTWGFSAKDRNNH LHHAIDAVIIAYANNSIVKAFS DFKKEQESNSAELYAKKISELD YKNKRKFFEPFSGFRQKVLDKI DEIFVSKPERKKPSGALHEETF RKEEEFYQSYGGKEGVLKALEL GKIRKVNGKIVKNGDMFRVDIF KHKKTNKFYAVPIYTMDFALKV LPNKAVARSKKGEIKDWILMDE NYEFCFSLYKDSLILIQTKDMQ EPEFVYYNAFTSSTVSLIVSKH | 137 | 181 | 45 | 316 | 360 | 45 | 316 | 360 | 45 |

TABLE 100-continued

Amino Acid Sequence of Cas9 Orthologs

| Species/ Composite ID | Amino acid sequence | REC2 start (AA pos) | REC2 stop (AA pos) | REC2 # AA deleted (n) | REC1$_{CT}$ start (AA pos) | REC1$_{CT}$ stop (AA pos) | REC1$_{CT}$ # AA deleted (n) | Rec$_{sub}$ start (AA pos) | Rec$_{sub}$ stop (AA pos) | Rec$_{sub}$ # AA deleted (n) |
|---|---|---|---|---|---|---|---|---|---|---|
| | DNKFETLSKNQKILFKNANEKE VIAKSIGIQNLKVFEKYIVSAL GEVTKAEFRQREDFKK (SEQ ID NO: 8) | | | | | | | | | |
| Bacteroides fragilis NCTC 9343 gi\|60683389\| ref\|YP_213533.1\| | MKRILGLDLGTNSIGWALVNEA ENKDERSSIVKLGVRVNPLTVD ELTNFEKGKSITTNADRTLKRG MRRNLQRYKLRRETLTEVLKEH KLITEDTILSENGNRTTFETYR LRAKAVTEEISLEEFARVLLMI NKKRGYKSSRKAKGVEEGTLID GMDIARELYNNNLTPGELCLQL LDAGKKFLPDFYRSDLQNELDR IWEKQKEYYPEILTDVLKEELR GKKRDAVWAICAKYFVWKENYT EWNKEKGKTEQQEREHKLEGIY SKRKRDEAKRENLQWRVNGLKE KLSLEQLVIVFQEMNTQINNSS GYLGAISDRSKELYFNKQTVGQ YQMEMLDKNPNASLRNMVFYRQ DYLDEFNMLWEKQAVYHKELTE ELKKEIRDIIIFYQRRLKSQKG LIGFCEFESRQIEVDIDGKKKI KTVGNRVISRSSPLFQEFKIWQ ILNNIEVTVVGKKRKRRKLKEN YSALFEELNDAEQLELNGSRRL CQEEKELLAQELFIRDKMTKSE VLKLLFDNPQELDLNFKTIDGN KTGYALFQAYSKMIEMSGHEPV DFKKPVEKVVEYIKAVFDLLNW NTDILGFNSNEELDNQPYYKLW HLLYSFEGDNTPTGNGRLIQKM TELYGFEKEYATILANVSFQDD YGSLSAKAIHKILPHLKEGNRY DVACVYAGYRHSESSLTREEIA NKVLKDRLMLLPKNSLHNPVVE KILNQMVNVINVIIDIYGKPDE IRVELARELKKNAKEREELTKS IAQTTKAHEEYKTLLQTEFGLT NVSRTDILRYKLYKELESCGYK TLYSNTYISREKLFSKEFDIEH IIPQARLFDDSFSNKTLEARSV NIEKGNKTAYDFVKEKFGESGA DNSLEHYLNNIEDLFKSGKISK TKYNKLKMAEQDIPDGFIERDL RNTQYIAKKALSMLNEISHRVV ATSGSVTDKLREDWQLIDVMKE LNWEKYKALGLVEYFEDRDGRQ IGRIKDWTKRNDHRHHAMDALT VAFTKDVFIQYENNKNASLDPN ANEHAIKNKYFQNGRAIAPMPL REFRAEAKKHLENTLISIKAKN KVITGNINKTRKKGGVNKNMQQ TPRGQLHLETIYGSGKQYLTKE EKVNASFDMRKIGTVSKSAYRD ALLKRLYENDNDPKKAFAGKNS LDKQPIWLDKEQMRKVPEKVKI VTLEAIYTIRKEISPDLKVDKV IDVGVRKILIDRLNEYGNDAKK AFSNLDKNPIWLNKEKGISIKR VTISGISNAQSLHVKKDKDGKP ILDENGRNIPVDFVNTGNNHHV AVYYRPVIDKRGQLVVDEAGNP KYELEEVVVSFFEAVTRANLGL PIIDKDYKTTEGWQFLFSMKQN EYFVFPNEKTGFNPKEIDLLDV ENYGLISPNLFRVQKFSLKNYV FRHHLETTIKDTSSILRGITWI DFRSSKGLDTIVKVRVNHIGQI VSVGEY (SEQ ID NO: 9) | 148 | 339 | 192 | 524 | 617 | 84 | 524 | 617 | 84 |

TABLE 100-continued

Amino Acid Sequence of Cas9 Orthologs

| Species/ Composite ID | Amino acid sequence | REC2 | | | REC1$_{CT}$ | | | Rec$_{sub}$ | | |
|---|---|---|---|---|---|---|---|---|---|---|
| | | start (AA pos) | stop (AA pos) | # AA deleted (n) | start (AA pos) | stop (AA pos) | # AA deleted (n) | start (AA pos) | stop (AA pos) | # AA deleted (n) |
| Bifidobacterium bifidum S17 gi\|310286728\| ref\| YP_003937986. | MSRKNYVDDYAISLDIGNASVG WSAFTPNYRLVRAKGHELIGVR LFDPADTAESRRMARTTRRRYS RRRWRLRLLDALFDQALSEIDP SFLARRKYSWVHPDDENNADCW YGSVLFDSNEQDKRFYEKYPTI YHLRKALMEDDSQHDIREIYLA IHHMVKYRGNFLVEGTLESSNA FKEDELLKLLGRITRYEMSEGE QNSDIEQDDENKLVAPANGQLA DALCATRGSRSMRVDNALEALS AVNDLSREQRAIVKAIFAGLEG NKLDLAKIFVSKEFSSENKKIL GIYFNKSDYEEKCVQIVDSGLL DDEEREFLDRMQGQYNAIALKQ LLGRSTSVSDSKCASYDAHRAN WNLIKLQLRTKENEKDINENYG ILVGWKIDSGQRKSVRGESAYE NMRKKANVFFKKMIETSDLSET DKNRLIHDIEEDKLFPIQRDSD NGVIPHQLHQNELKQIIKKQGK YYPFLLDAFEKDGKQINKIEGL LTFRVPYFVGPLVVPEDLQKSD NSENHWMVRKKKGEITPWNFDE MVDKDASGRKFIERLVGTDSYL LGEPTLPKNSLLYQEYEVLNEL NNVRLSVRTGNHWNDKRRMRLG REEKTLLCQRLFMKGQTVTKRT AENLLRKEYGRTYELSGLSDES KFTSSLSTYGKMCRIFGEKYVN EHRDLMEKIVELQTVFEDKETL LHQLRQLEGISEADCALLVNTH YTGWGRLSRKLLTTKAGECKIS DDFAPRKHSIIEIMRAEDRNLM EIITDKQLGFSDWIEQENLGAE NGSSLMEVVDDLRVSPKVKRGI IQSIRLIDDISKAVGKRPSRIF LELADDIQPSGRTISRKSRLQD LYRNANLGKEFKGIADELNACS DKDLQDDRLFLYYTQLGKDMYT GEELDLDRLSSAYDIDHIIPQA VTQNDSIDNRVLVARAENARKT DSFTYMPQIADRMRNFWQILLD NGLISRVKFERLTRQNEFSERE KERFVQRSLVETRQIMKNVATL MRQRYGNSAAVIGLNAELTKEM HRYLGFSHKNRDINDYHHAQDA LCVGIAGQPAANRGFFADGEVS DGAQNSYNQYLRDYLRGYREKL SAEDRKQGRAFGFIVGSMRSQD EQKRVNPRTGEVVWSEEDKDYL RKVMNYRKMLVTQKVGDDFGAL YDETRYAATDPKGIKGIPFDGA KQDTSLYGGFSSAKPAYAVLIE SKGKTRLVNVTMQEYSLLGDRP SDDELRKVLAKKKSEYAKANIL LRHVPKMQLIRYGGGLMVIKSA GELNNAQQLWLPYEEYCYFDDL SQGKGSLEKDDLKKLLDSILGS VQCLYPWHRFTEEELADLHVAF DKLPEDEKKNVITGIVSALHAD AKTANLSIVGMTGSWRRMNNKS GYTFSDEDEFIFQSPSGLFEKR VTVGELKRKAKKEVNSKYRTNE KRLPTLSGASQP (SEQ ID NO: 10) | 173 | 335 | 163 | 516 | 607 | 87 | 516 | 607 | 87 |
| Veillonella atypica ACS-134-V-Col7a gi\|303229466\| ref\| | METQTSNQLITSHLKDYPKQDY FVGLDIGTNSVGWAVTNTSYEL LKFHSHKMWGSRLFEEGESAVT RRGFRSMRRRLERRKLRLKLLE ELFADAMAQVDSTFFIRLHESK | 185 | 339 | 155 | 574 | 663 | 79 | 574 | 663 | 79 |

TABLE 100-continued

Amino Acid Sequence of Cas9 Orthologs

| Species/ Composite ID | Amino acid sequence | REC2 | | | REC1$_{CT}$ | | | Rec$_{sub}$ | | |
|---|---|---|---|---|---|---|---|---|---|---|
| | | start (AA pos) | stop (AA pos) | # AA deleted (n) | start (AA pos) | stop (AA pos) | # AA deleted (n) | start (AA pos) | stop (AA pos) | # AA deleted (n) |
| ZP_07316256.1 | YHYEDKTTGHSSKHILFIDEDY TDQDYFTEYPTIYHLRKDLMEN GTDDIRKLFLAVHHILKYRGNF LYEGATFNSNAFTFEDVLKQAL VNITFNCFDTNSAISSISNILM ESGKTKSDKAKAIERLVDTYTV FDEVNTPDKPQKEQVKEDKKTL KAFANLVLGLSANLIDLFGSVE DIDDDLKKLQIVGDTYDEKRDE LAKVWGDEIHIIDDCKSVYDAI ILMSIKEPGLTISQSKVKAFDK HKEDLVILKSLLKLDRNVYNEM FKSDKKGLHNYVHYIKQGRTEE TSCSREDFYKYTKKIVEGLADS KDKEYILNEIELQTLLPLQRIK DNGVIPYQLHLEELKVILDKCG PKFPFLHTVSDGFSVTEKLIKM LEFRIPYYVGPLNTHHNIDNGG FSWAVRKQAGRVTPWNFEEKID REKSAAAFIKNLTNKCTYLFGE DVLPKSSLLYSEFMLLNELNNV RIDGKALAQGVKQHLIDSIFKQ DHKKMTKNRIELFLKDNNYITK KHKPEITGLDGEIKNDLTSYRD MVRILGNNFDVSMAEDIITDIT IFGESKKMLRQTLRNKFGSQLN DETIKKLSKLRYRDWGRLSKKL LKGIDGCDKAGNGAPKTIIELM RNDSYNLMEILGDKFSFMECIE EENAKLAQGQVVNPHDIIDELA LSPAVKRAVWQALRIVDEVAHI KKALPSRIFVEVARTNKSEKKK KDSRQKRLSDLYSAIKKDDVLQ SGLQDKEFGALKSGLANYDDAA LRSKKLYLYYTQMGRCAYTGNI IDLNQLNTDNYDIDHIYPRSLT KDDSFDNLVLCERTANAKKSDI YPIDNRIQTKQKPFWAFLKHQG LISERKYERLTRIAPLTADDLS GFIARQLVETNQSVKATTTLLR RLYPDIDVVFVKAENVSDFRHN NNFIKVRSLNHHHAKDAYLNI VVGNVYHEKFTRNFRLFFKKNG ANRTYNLAKMFNYDVICTNAQD GKAWDVKTSMNTVKKMMASNDV RVTRRLLEQSGALADATIYKAS VAAKAKDGAYIGMKTKYSVFAD VTKYGGMTKIKNAYSIIVQYTG KKGEEIKEIVPLPIYLINRNAT DIELIDYVKSVIPKAKDISIKY RKLCINQLVKVNGFYYYLGGKT NDKIYIDNAIELVVPHDIATYI KLLDKYDLLRKENKTLKASSIT TSIYNINTSTVVSLNKVGIDVF DYFMSKLRTPLYMKMKGNKVDE LSSTGRSKFIKMTLEEQSIYLL EVLNLLTNSKTTFDVKPLGITG SRSTIGVKIHNLDEFKIINESI TGLYSNEVTIV (SEQ ID NO: 11) | | | | | | | | | |
| Lactobacillus rhamnosus GG gi\|258509199\| ref\| YP_003171950.1 | MTKLNQPYGIGLDIGSNSIGFA VVDANSHLLRLKGETAIGARLF REGQSAADRRGSRTTRRRLSRT RWRLSFLRDFFAPHITKIDPDF FLRQKYSEISPKDKDRFKYEKR LENDRTDAEFYEDYPSMYHLRL HLMTHTHKADPREIFLAIHHIL KSRGHFLTPGAAKDFNTDKVDL EDIFPALTEAYAQVYPDLELTF DLAKADDFKAKLLDEQATPSDT QKALVNLLLSSDGEKEIVKKRK | 169 | 320 | 152 | 559 | 645 | 78 | 559 | 645 | 78 |

TABLE 100-continued

Amino Acid Sequence of Cas9 Orthologs

| Species/ Composite ID | Amino acid sequence | REC2 start (AA pos) | REC2 stop (AA pos) | REC2 # AA deleted (n) | REC1_CT start (AA pos) | REC1_CT stop (AA pos) | REC1_CT # AA deleted (n) | Rec_sub start (AA pos) | Rec_sub stop (AA pos) | Rec_sub # AA deleted (n) |
|---|---|---|---|---|---|---|---|---|---|---|
| | QVLTEFAKAITGLKTKFNLALG TEVDEADASNWQFSMGQLDDKW SNIETSMTDQGTEIFEQIQELY RARLLNGIVPAGMSLSQAKVAD YGQHKEDLELFKTYLKKLNDHE LAKTIRGLYDRYINGDDAKPFL REDFVKALTKEVTAHPNEVSEQ LLNRMGQANFMLKQRTKANGAI PIQLQQRELDQIIANQSKYYDW LAAPNPVEAHRWKMPYQLDELL NFHIPYYVGPLITPKQQAESGE NVFAWMVRKDPSGNITPYNFDE KVDREASANTFIQRMKTTDTYL IGEDVLPKQSLLYQKYEVLNEL NNVRINNECLGTDQKQRLIREV FERHSSVTIKQVADNLVAHGDF ARRPEIRGLADEKRFLSSLSTY HQLKEILHEAIDDPTKLLDIEN IITWSTVFEDHTIFETKLAEIE WLDPKKINELSGIRYRGWGQFS RKLLDGLKLGNGHTVIQELMLS NHNLMQILADETLKETMTELNQ DKLKTDDIEDVINDAYTSPSNK KALRQVLRVVEDIKHAANGQDP SWLFIETADGTGTAGKRTQSRQ KQIQTVYANAAQELIDSAVRGE LEDKIADKASFTDRLVLYFMQG GRDIYTGAPLNIDQLSHYDIDH ILPQSLIKDDSLDNRVLVNATI NREKNNVFASTLFAGKMKATWR KWHEAGLISGRKLRNLMLRPDE IDKFAKGFVARQLVETRQIIKL TEQIAAAQYPNTKIIAVKAGLS HQLREELDFPKNRDVNHYHHAF DAFLAARIGTYLLKRYPKLAPF FTYGEFAKVDVKKFREFNFIGA LTHAKKNIIAKDTGEIVWDKER DIRELDRIYNFKRMLITHEVYF ETADLFKQTIYAAKDSKERGGS KQLIPKKQGYPTQVYGGYTQES GSYNALVRVAEADTTAYQVIKI SAQNASKIASANLKSREKGKQL LNEIVVKQLAKRRKNWKPSANS FKIVIPRFGMGTLFQNAKYGLF MVNSDTYYRNYQELWLSRENQK LLKKLFSIKYEKTQMNHDALQV YKAIIDQVEKFFKLYDINQFRA KLSDAIERFEKLPINTDGNKIG KTETLRQILIGLQANGTRSNVK NLGIKTDLGLLQVGSGIKLDKD TQIVYQSPSGLFKRRIPLADL (SEQ ID NO: 12) | | | | | | | | | | |
| Filifactor alocis ATCC 35896 gi\|374307738\| ref\| YP_005054169.1 | MTKEYYLGLDVGTNSVGWAVTD SQYNLCKFKKKDMWGIRLFESA NTAKDRRLQRGNRRRLERKKQR IDLLQEIFSPEICKIDPTFFIR LNESRLHLEDKSNDFKYPLFIE KDYSDIEYYKEFPTIFHLRKHL IESEEKQDIRLIYLALHNIIKT RGHFLIDGDLQSAKQLRPILDT FLLSLQEEQNLSVSLSENQKDE YEEILKNRSIAKSEKVKKLKNL FEISDELEKEEKKAQSAVIENF CKFIVGNKGDVCKFLRVSKEEL EIDSFSFSEGKYEDDIVKNLEE KVPEKVYLFEQMKAMYDWNILV DILETEEYISFAKVKQYEKHKT NLRLLRDIILKYCTKDEYNRMF NDEKEAGSYTAYVGKLKKNNKK YWIEKKRNPEEFYKSLGKLLDK IEPLKEDLEVLTMMIEECKNHT | 166 | 314 | 149 | 508 | 592 | 76 | 508 | 592 | 76 |

TABLE 100-continued

Amino Acid Sequence of Cas9 Orthologs

| Species/ Composite ID | Amino acid sequence | REC2 | | | REC1$_{CT}$ | | | Rec$_{sub}$ | | |
|---|---|---|---|---|---|---|---|---|---|---|
| | | start (AA pos) | stop (AA pos) | # AA deleted (n) | start (AA pos) | stop (AA pos) | # AA deleted (n) | start (AA pos) | stop (AA pos) | # AA deleted (n) |
| | LLPIQKNDNGVIPHQVHEVEL KKILENAKKYYSFLTETDKDGY SVVQKIESIFRFRIPYYVGPLS TRHQEKGSNVWMVRKPGREDRI YPWNMEEIIDFEKSNENFITRM TNKCTYLIGEDVLPKHSLLYSK YMVLNELNNVKVRGKKLPTSLK QKVFEDLFENKSKVTGKNLLEY LQIQDKDIQIDDLSGFDKDFKT SLKSYLDFKKQIFGEEIEKESI QNMIEDIIKWITIYGNDKEMLK RVIRANYSNQLTEEQMKKITGF QYSGWGNFSKMFLKGISGSDVS TGETFDIITAMWETDNNLMQIL SKKFTFMDNVEDENSGKVGKID KITYDSTVKEMFLSPENKRAVW QTIQVAEEIKKVMGCEPKKIFI EMARGGEKVKKRTKSRKAQLLE LYAACEEDCRELIKEIEDRDER DFNSMKLFLYYTQFGKCMYSGD DIDINELIRGNSKWDRDHIYPQ SKIKDDSIDNLVLVNKTYNAKK SNELLSEDIQKKMHSFWLSLLN KKLITKSKYDRLTRKGDFTDEE LSGFIARQLVETRQSTKAIADI FKQIYSSEVVYVKSSLVSDFRK KPLNYLKSRRVNDYHHAKDAYL NIVVGNVYNKKFTSNPIQWMKK NRDTNYSLNKVFEHDVVINGEV IWEKCTYHEDTNTYDGGTLDRI RKIVERDNILYTEYAYCEKGEL FNATIQKNGNSTVSLKKGLDV KKYGGYFSANTSYFSLIEFEDK KGDRARHIIGVPIYIANMLEHS PSAFLEYCEQKGYQNVRILVEK IKKNSLLIINGYPLRIRGENEV DTSFKRAIQLKLDQKNYELVRN IEKFLEKYVEKKGNYPIDENRD HITHEKMNQLYEVLLSKMKKEN KKGMADPSDRIEKSKPKFIKLE DLIDKINVINKMLNLLRCDNDT KADLSLIELPKNAGSFVVKKNT IGKSKIILVNQSVTGLYENRRE L (SEQ ID NO: 13) | | | | | | | | | |
| Oenococcus kitaharae DSM 17330 gi\|366983953\| gb\|EHN59352.1\| | MARDYSVGLDIGTSSVGWAAID NKYHLIRAKSKNLIGVRLFDSA VTAEKRRGYRTTRRRLSRRHWR LRLLNDIFAGPLTDFGDENFLA RLKYSWVHPQDQSNQAHFAAGL LFDSKEQDKDFYRKYPTIYHLR LALMNDDQKHDLREVYLAIHHL VKYRGHFLIEGDVKADSAFDVH TFADAIQRYAESNNSDENLLGK IDEKKLSAALTDKHGSKSQRAE TAETAFDILDLQSKKQIQAILK SVVGNQANLMAIFGLDSSAISK DEQKNYKFSFDDADIDEKIADS EALLSDTEFEFLCDLKAAFDGL TLKMLLGDDKTVSAAMVRRENE HQKDWEYIKSHIRNAKNAGNGL YEKSKKFDGINAAYLALQSDNE DDRKKAKKIFQDEISSADIPDD VKADFLKKIDDDQFLPIQRTKN NGTIPHQLHRNELEQIIEKQGI YYPFLKDTYQENSHELNKITAL INFRVPYYVGPLVEEEQKIADD GKNIPDPTNHWMVRKSNDTITP WNLSQVVDLDKSGRRFIERLTG TDTYLIGEPTLPKNSLLYQKED VLQELNNIRVSGRRLDIRAKQD AFEHLFKVQKTVSATNLKDFLV | 169 | 317 | 149 | 555 | 639 | 80 | 555 | 639 | 80 |

TABLE 100-continued

Amino Acid Sequence of Cas9 Orthologs

| Species/ Composite ID | Amino acid sequence | REC2 start (AA pos) | REC2 stop (AA pos) | REC2 # AA deleted (n) | REC1_{CT} start (AA pos) | REC1_{CT} stop (AA pos) | REC1_{CT} # AA deleted (n) | Rec_{sub} start (AA pos) | Rec_{sub} stop (AA pos) | Rec_{sub} # AA deleted (n) |
|---|---|---|---|---|---|---|---|---|---|---|
| | QAGYISEDTQIEGLADVNGKNF NNALTTYNYLVSVLGREFVENP SNEELLEEITELQTVFEDKKVL RRQLDQLDGLSDHNREKLSRKH YTGWGRISKKLLTTKIVQNADK IDNQTFDVPRMNQSIIDTLYNT KMNLMEIINNAEDDFGVRAWID KQNTTDGDEQDVYSLIDELAGP KEIKRGIVQSFRILDDITKAVG YAPKRVYLEFARKTQESHLTNS RKNQLSTLLKNAGLSELVTQVS QYDAAALQNDRLYLYFLQQGKD MYSGEKLNLDNLSNYDIDHIIP QAYTKDNSLDNRVLVSNITNRR KSDSSNYLPALIDKMRPFWSVL SKQGLLSKHKFANLTRTRDFDD MEKERFIARSLVETRQIIKNVA SLIDSHFGGETKAVAIRSSLTA DMRRYVDIPKNRDINDYHHAFD ALLFSTVGQYTENSGLMKKGQL SDSAGNQYNRYIKEWIHAARLN AQSQRVNPFGFVVGSMRNAAPG KLNPETGEITPEENADWSIADL DYLHKVMNFRKITVTRRLKDQK GQLYDESRYPSVLHDAKSKASI NFDKHKPVDLYGGFSSAKPAYA ALIKFKNKFRLVNVLRQWTYSD KNSEDYILEQIRGKYPKAEMVL SHIPYGQLVKKDGALVTISSAT ELHNFEQLWLPLADYKLINTLL KTKEDNLVDILHNRLDLPEMTI ESAFYKAFDSILSFAFNRYALH QNALVKLQAHRDDPNALNYEDK QQTLERILDALHASPASSDLKK INLSSGFGRLFSPSHFTLADTD EFIFQSVTGLFSTQKTVAQLYQ ETK (SEQ ID NO: 14) | | | | | | | | | | |
| Fructobacillus fructosus KCTC 3544 gi\|339625081\| ref\| ZP_08660870.1 | MVYDVGLDIGTGSVGWVALDEN GKLARAKGKNLVGVRLFDTAQT AADRRGFRTTRRRLSRRKWRLR LLDELFSAEINEIDSSFFQRLK YSYVHPKDEENKAHYYGGYLFP TEEETKKFHRSYPTIYHLRQEL MAQPNKRFDIREIYLAIHHLVK YRGHFLSSQEKITIGSTYNPED LANAIEVYADEKGLSWELNNPE QLTEIISGEAGYGLNKSMKADE ALKLFEFDNNQDKVAIKTLLAG LTGNQIDFAKLFGKDISDKDEA KLWKLKLDDEALEEKSQTILSQ LTDEEIELFHAVVQAYDGFVLI GLLNGADSVSAAMVQLYDQHRE DRKLLKSLAQKAGLKHKRFSEI YEQLALATDEATIKNGISTARE LVEESNLSKEVKEDTLRRLDEN EFLPKQRTKANSVIPHQLHLAE LQKILQNQGQYYPFLLDTFEKE DGQDNKIEELLRFRIPYYVGPL VTKKDVEHAGGDADNHWVERNE GFEKSRVTPWNFDKVFNRDKAA RDFIERLTGNDTYLIGEKTLPQ NSLRYQLFTVLNELNNVRVNGK KFDSKTKADLINDLFKARKTVS LSALKDYLKAQGKGDVTITGLA DESKFNSSLSSYNDLKKTFDAE YLENEDNQETLEKIIEIQTVFE DSKIASRELSKLPLDDDQVKKL SQTHYTGWGRLSEKLLDSKIID ERGQKVSILDKLKSTSQNFMSI INNDKYGVQAWITEQNTGSSKL TFDEKVNELTTSPANKRGIKQS | 168 | 314 | 147 | 488 | 571 | 76 | 488 | 571 | 76 |

TABLE 100-continued

Amino Acid Sequence of Cas9 Orthologs

| Species/ Composite ID | Amino acid sequence | REC2 start (AA pos) | REC2 stop (AA pos) | REC2 # AA deleted (n) | REC1$_{CT}$ start (AA pos) | REC1$_{CT}$ stop (AA pos) | REC1$_{CT}$ # AA deleted (n) | Rec$_{sub}$ start (AA pos) | Rec$_{sub}$ stop (AA pos) | Rec$_{sub}$ # AA deleted (n) |
|---|---|---|---|---|---|---|---|---|---|---|
| | FAVLNDIKKAMKEEPRRVYLEF AREDQTSVRSVPRYNQLKEKYQ SKSLSEEAKVLKKTLDGNKNKM SDDRYFLYFQQQGKDMYTGRPI NFERLSQDYDIDHIIPQAFTKD DSLDNRVLVSRPENARKSDSFA YTDEVQKQDGSLWTSLLKSGFI NRKKYERLTKAGKYLDGQKTGF IARQLVETRQIIKNVASLIEGE YENSKAVAIRSEITADMRLLVG IKKHREINSFHHAFDALLITAA GQYMQNRYPDRDSTNVYNEFDR YTNDYLKNLRQLSSRDEVRRLK SFGFVVGTMRKGNEDWSEENTS YLRKVMMFKNILTTKKTEKDRG PLNKETIFSPKSGKKLIPLNSK RSDTALYGGYSNVYSAYMTLVR ANGKNLLIKIPISIANQIEVGN LKINDYIVNNPAIKKFEKILIS KLPLGQLVNEDGNLIYLASNEY RHNAKQLWLSTTDADKIASISE NSSDEELLEAYDILTSENVKNR FPFFKKDIDKLSQVRDEFLDSD KRIAVIQTILRGLQIDAAYQAP VKIISKKVSDWHKLQQSGGIKL SDNSEMIYQSATGIFETRVKIS DLL (SEQ ID NO: 15) | | | | | | | | | | |
| Catenibacterium mitsuokai DSM 15897 gi\|224543312\| ref\| ZP_03683851.1 | IVDYCIGLDLGTGSVGWAVVDM NHRLMKRNGKHLWGSRLFSNAE TAANRRASRSIRRRYNKRRERI RLLRAILQDMVLEKDPTFFIRL EHTSFLDEEDKAKYLGTDYKDN YNLFIDEDENDYTYYHKYPTIY HLRKALCESTEKADPRLIYLAL HHIVKYRGNFLYEGQKFNMDAS NIEDKLSDIFTQFTSFNNIPYE DDEKKNLEILEILKKPLSKKAK VDEVMTLIAPEKDYKSAFKELV TGIAGNKMNVTKMILCEPIKQG DSEIKLKFSDSNYDDQFSEVEK DLGEYVEFVDALHNVYSWVELQ TIMGATHTDNASISEAMVSRYN KHHDDLKLLKDCIKNNVPNKYF DMFRNDSEKSKGYYNYINRPSK APVDEFYKYVKKCIEKVDTPEA KQILNDIELENFLLKQNSRING SVPYQMQLDEMIKIIDNQAEYY PILKEKREQLLSILTFRIPYYF GPLNETSEHAWIKRLEGKENQR ILPWNYQDIVDVDATAEGFIKR MRSYCTYFPDEEVLPKNSLIVS KYEVYNELNKIRVDDKLLEVDV KNDIYNELFMKNKTVTEKKLKN WLVNNQCCSKDAEIKGFQKENQ FSTSLTPWIDFTNIFGKIDQSN FDLIENIIYDLTVFEDKKIMKR RLKKKYALPDDKVKQILKLKYK DWSRLSKKLLDGIVADNRFGSS VTVLDVLEMSRLNLMEIINDKD LGYAQMIEEATSCPEDGKFTYE EVERLAGSPALKRGIWQSLQIV EEITKVMKCRPKYIYIEFERSE EAKERTESKIKKLENVYKDLDE QTKKEYKSVLEELKGFDNTKKI SSDSLFLYFTQLGKCMYSGKKL DIDSLDKYQIDHIVPQSLVKDD SFDNRVLVVPSENQRKLDDLVV PFDIRDKMYRFWKLLFDHELIS PKKFYSLIKTEYTERDEERFIN RQLVETRQITKNVTQIIEDHYS TTKVAAIRANLSHEFRVKNHIY | 173 | 318 | 146 | 511 | 594 | 78 | 511 | 594 | 78 |

TABLE 100-continued

Amino Acid Sequence of Cas9 Orthologs

| Species/ Composite ID | Amino acid sequence | REC2 start (AA pos) | REC2 stop (AA pos) | REC2 # AA deleted (n) | REC1$_{CT}$ start (AA pos) | REC1$_{CT}$ stop (AA pos) | REC1$_{CT}$ # AA deleted (n) | Rec$_{sub}$ start (AA pos) | Rec$_{sub}$ stop (AA pos) | Rec$_{sub}$ # AA deleted (n) |
|---|---|---|---|---|---|---|---|---|---|---|
| | KNRDINDYHHAHDAYIVALIGG FMRDRYPNMHDSKAVYSEYMKM FRKNKNDQKRWKDGFVINSMNY PYEVDGKLIWNPDLINEIKKCF YYKDCYCTTKLDQKSGQLFNLT VLSNDAHADKGVTKAVVPVNKN RSDVHKYGGFSGLQYTIVAIEG QKKKGKKTELVKKISGVPLHLK AASINEKINYIEEKEGLSDVRI IKDNIPVNQMIEMDGGEYLLTS PTEYVNARQLVLNEKQCALIAD IYNAIYKQDYDNLDDILMIQLY IELTNKMKVLYPAYRGIAEKFE SMNENYVVISKEEKANIIKQML IVMHRGPQNGNIVYDDFKISDR IGRLKTKNHNLNNIVFISQSPT GIYTKKYKL (SEQ ID NO: 16) | | | | | | | | | |
| Finegoldia magna ATCC 29328 gi\|169823755\| ref\| YP_001691366.1 | MKSEKKYYIGLDVGTNSVGWAV TDEFYNILRAKGKDLWGVRLFE KADTAANTRIFRSGRRRNDRKG MRLQILREIFEDEIKKVDKDFY DRLDESKFWAEDKKVSGKYSLF NDKNFSDKQYFEKFPTIFHLRK YLMEEHGKVDIRYYFLAINQMM KRRGHFLIDGQISHVTDDKPLK EQLILLINDLLKIELEEELMDS IFEILADVNEKRTDKKNNLKEL IKGQDFNKQEGNILNSIFESIV TGKAKIKNIISDEDILEKIKED NKEDFVLTGDSYEENLQYFEEV LQENITLFNTLKSTYDFLILQS ILKGKSTLSDAQVERYDEHKKD LEILKKVIKKYDEDGKLFKQVF KEDNGNGYVSYIGYYLNKNKKI TAKKKISNIEFTKYVKGILEKQ CDCEDEDVKYLLGKIEQENFLL KQISSSINSVIPHQIHLFELDKI LENLAKNYPSFNNKKEEFTKIE KIRKTFTFRIPYYVGPLNDYHK NNGGNAWIFRNKGEKIRPWNFE KIVDLHKSEEEFIKRMLNQCTY LPEETVLPKSSILYSEYMVLNE LNNLRINGKPLDTDVKLKLIEE LFKKKTKVTLKSIRDYMVRNNF ADKEDFDNSEKNLEIASNMKSY IDFNNILEDKEDVEMVEDLIEK ITIHTGNKKLLKKYIEETYPDL SSSQIQKIINLKYKDWGRLSRK LLDGIKGTKKETEKTDTVINFL RNSSDNLMQIIGSQNYSFNEYI DKLRKKYIPQEISYEVVENLYV SPSVKKMIWQVIRVTEEITKVM GYDPDKIFIEMAKSEEEKKTTI SRKNKLLDLYKAIKKDERDSQY EKLLTGLNKLDDSDLRSRKLYL YYTQMGRDMYTGEKIDLDKLFD STHYDKDHIIPQSMKKDDSIIN NLVLVNKNANQTTKGNIYPVPS SIRNNPKIYNYWKYLMEKEFIS KEKYNRLIRNTPLTNEELGGFI NRQLVETRQSTKAIKELFEKFY QKSKIIPVKASLASDLRKDMNT LKSREVNDLHHAHDAFLNIVAG DVWNREFTSNPINYVKENREGD KVKYSLSKDFTRPRKSKGKVIW TPEKGRKLIVDTLNKPSVLISN ESHVKKGELFNATIAGKKDYKK GKIYLPLKKDDRLQDVSKYGGY KAINGAFFFLVEHTKSKKRIRS IELFPLHLLSKFYEDKNTVLDY | 168 | 313 | 146 | 452 | 534 | 77 | 452 | 534 | 77 |

TABLE 100-continued

Amino Acid Sequence of Cas9 Orthologs

| Species/ Composite ID | Amino acid sequence | REC2 | | | REC1$_{CT}$ | | | Rec$_{sub}$ | | |
|---|---|---|---|---|---|---|---|---|---|---|
| | | start (AA pos) | stop (AA pos) | # AA deleted (n) | start (AA pos) | stop (AA pos) | # AA deleted (n) | start (AA pos) | stop (AA pos) | # AA deleted (n) |
| | AINVLQLQDPKIIIDKINYRTE IIIDNFSYLISTKSNDGSITVK PNEQMYWRVDEISNLKKIENKY KKDAILTEEDRKIMESYIDKIY QQFKAGKYKNRRTTDTIIEKYE IIDLDTLDNKQLYQLLVAFISL SYKTSNNAVDFTVIGLGTECGK PRITNLPDNTYLVYKSITGIYE KRIRIK (SEQ ID NO: 17) | | | | | | | | | |
| Coriobacterium glomeran sPW2 gi\|328956315\| ref\| YP_004373648.1 | MKLRGIEDDYSIGLDMGTSSVG WAVTDERGTLAHFKRKPTWGSR LFREAQTAAVARMPRGQRRRYV RRRWRLDLLQKLFEQQMEQADP DFFIRLRQSRLLRDDRAEEHAD YRWPLFNDCKFTERDYYQRFPT IYHVRSWLMETDEQADIRLIYL ALHNIVKHRGNFLREGQSLSAK SARPDEALNHLRETLRVWSSER GFECSIADNGSILAMLTHPDLS PSDRRKKIAPLFDVKSDDAAAD KKLGIALAGAVIGLKTEFKNIF GDFPCEDSSIYLSNDEAVDAVR SACPDDCAELFDRLCEVYSAYV LQGLLSYAPGQTISANMVEKYR RYGEDLALLKKLVKIYAPDQYR MFFSGATYPGTGIYDAAQARGY TKYNLGPKKSEYKPSESMQYDD FRKAVEKLFAKTDARADERYRM MMDRFDKQQFLRRLKTSDNGSI YHQLHLEELKAIVENQGRFYPF LKRDADKLVSLVSFRIPYYVGP LSTRNARTDQHGENRFAWSERK PGMQDEPIFPWNWESIIDRSKS AEKFILRMTGMCTYLQQEPVLP KSSLLYEEFCVLNELNGAHWSI DGDDEHRFDAADREGIIEELFR RKRTVSYGDVAGWMERERNQIG AHVCGGQGEKGFESKLGSYIFF CKDVFKVERLEQSDYPMIERII LWNTLFEDRKILSQRLKEEYGS RLSAEQIKTICKKRFTGWGRLS EKFLTGITVQVDEDSVSIMDVL REGCPVSGKRGRAMVMMEILRD EELGFQKKVDDENRAFFAENAQ ALGVNELPGSPAVRRSLNQSIR IVDEIASIAGKAPANIFIEVTR DEDPKKKGRRTKRRYNDLKDAL EAFKKEDPELWRELCETAPNDM DERLSLYFMQRGKCLYSGRAID IHQLSNAGIYEVDHIIPRTYVK DDSLENKALVYREENQRKTDML LIDPEIRRRMSGYWRMLHEAKL IGDKKFRNLLRSIDDKALKGF IARQLVETGQMVKLVRSLLEAR YPETNIISVKASISHDLRTAAE LVKCREANDFHHAHDAFLACRV GLFIQKRHPCVYENPIGLSQVV RNYVRQQADIFKRCRTIPGSSG FIVNSFMTSGFDKETGEIFKDD WDAEAEVEGIRRSLNFRQCFIS RMPFEDHGVFWDATIYSPRAKK TAALPLKQGLNPSRYGSFSREQ FAYFFIYKARNPRKEQTLFEFA QVPVRLSAQIRQDENALERYAR ELAKDQGLEFIRIERSKILKNQ | 175 | 318 | 144 | 511 | 592 | 82 | 511 | 592 | 82 |

TABLE 100-continued

Amino Acid Sequence of Cas9 Orthologs

| Species/<br>Composite<br>ID | Amino acid sequence | REC2 start (AA pos) | REC2 stop (AA pos) | REC2 # AA deleted (n) | REC1_CT start (AA pos) | REC1_CT stop (AA pos) | REC1_CT # AA deleted (n) | Rec_sub start (AA pos) | Rec_sub stop (AA pos) | Rec_sub # AA deleted (n) |
|---|---|---|---|---|---|---|---|---|---|---|
|  | LIEIDGDRLCITGKEEVRNACE<br>LAFAQDEMRVIRMLVSEKPVSR<br>ECVISLFNRILLHGDQASRRLS<br>KQLKLALLSEAFSEASDNVQRN<br>VVLGLIAIFNGSTNMVNLSDIG<br>GSKFAGNVRIKYKKELASPKVN<br>VHLIDQSVTGMFERRTKIGL<br>(SEQ ID NO: 18) |  |  |  |  |  |  |  |  |  |
| *Eubacterium yurii* ATCC 43715 gi\|306821691\|ref\|ZP_07455288.1 | MENKQYYIGLDVGTNSVGWAVT<br>DTSYNLLRAKGKDMWGARLFEK<br>ANTAAERRTKRTSRRRSEREKA<br>RKAMLKELFADEINRVDPSFFI<br>RLEESKFFLDDRSENNRQRYTL<br>FNDATFTDKDYYEKYKTIPHLR<br>SALINSDEKFDVRLVFLAILNL<br>FSHRGHFLNASLKGDGDIQGMD<br>VFYNDLVESCEYFEIELPRITN<br>IDNFEKILSQKGKSRTKILEEL<br>SEELSISKKDKSKYNLIKLISG<br>LEASVVELYNIEDIQDENKKIK<br>IGFRESDYEESSLKVKEIIGDE<br>YFDLVERAKSVHDMGLLSNIIG<br>NSKYLCEARVEAYENHHKDLLK<br>IKELLKKYDKKAYNDMFRKMTD<br>KNYSAYVGSVNSNIAKERRSVD<br>KRKIEDLYKYIEDTALKNIPDD<br>NKDKIEILEKIKLGEFLKKQLT<br>ASNGVIPNQLQSRELRAILKKA<br>ENYLPFLKEKGEKNLTVSEMII<br>QLFEFQIPYYVGPLDKNPKKDN<br>KANSWAKIKQGGRILPWNFEDK<br>VDVKGSRKEFIEKMVRKCTYIS<br>DEHTLPKQSLLYEKFMVLNEIN<br>NIKIDGEKISVEAKQKIYNDLF<br>VKGKKVSQKDIKKELISLNIMD<br>KDSVLSGTDTVCNAYLSSIGKF<br>TGVFKEEINKQSIVDMIEDIIF<br>LKTVYGDEKRFVKEEIVEKYGD<br>EIDKDKIKRILGFKFSNWGNLS<br>KSFLELEGADVGTGEVRSIIQS<br>LWETNFNLMELLSSRFTYMDEL<br>EKRVKKLEKPLSEWTIEDLDDM<br>YLSSPVKRMIWQSMKIVDEIQT<br>VIGYAPKRIFVEMTRSEGEKVR<br>TKSRKDRLKELYNGIKEDSKQW<br>VKELDSKDESYFRSKKMYLYYL<br>QKGRCMYSGEVIELDKLMDDNL<br>YDIDHIYPRSFVKDDSLDNLVL<br>VKKEINNRKQNDPITPQIQASC<br>QGFWKILHDQGFMSNEKYSRLT<br>RKTQEFSDEEKLSFINRQIVET<br>GQATKCMAQILQKSMGEDVDVV<br>FSKARLVSEFRHKFELFKSRLI<br>NDFHHANDAYLNIVVGNSYFVK<br>FTRNPANFIKDARKNPDNPVYK<br>YHMDRFFERDVKSKSEVAWIGQ<br>SEGNSGTIVIVKKTMAKNSPLI<br>TKKVEEGHGSITKETIVGVKEI<br>KFGRNKVEKADKTPKKPNLQAY<br>RPIKTSDERLCNILRYGGRTSI<br>SISGYCLVEYVKKRKTIRSLEA<br>IPVYLGRKDSLSEEKLLNYFRY<br>NLNDGGKDSVSDIRLCLPFIST<br>NSLVKIDGYLYYLGGKNDDRIQ<br>LYNAYQLKMKKEEVEYIRKIEK | 169 | 310 | 142 | 552 | 633 | 76 | 552 | 633 | 76 |

TABLE 100-continued

Amino Acid Sequence of Cas9 Orthologs

| Species/ Composite ID | Amino acid sequence | REC2 | | | REC1$_{CT}$ | | | Rec$_{sub}$ | | |
|---|---|---|---|---|---|---|---|---|---|---|
| | | start (AA pos) | stop (AA pos) | # AA deleted (n) | start (AA pos) | stop (AA pos) | # AA deleted (n) | start (AA pos) | stop (AA pos) | # AA deleted (n) |
| | AVSMSKFDEIDREKNPVLTEEK NIELYNKIQDKFENTVFSKRMS LVKYNKKDLSFGDFLKNKKSKF EEIDLEKQCKVLYNIIFNLSNL KEVDLSDIGGSKSTGKCRCKKN ITNYKEFKLIQQSITGLYSCEK DLMTI (SEQ ID NO: 19) | | | | | | | | | |
| Peptoniphilus duerdenii ATCC BAA-1640 gi\|304438954\|ref\|ZP_07398877.1 | MKNLKEYYIGLDIGTASVGWAV TDESYNIPKFNGKKMWGVRLFD DAKTAEERRTQRGSRRRLNRRK ERINLLQDLFATEISKVDPNFF LRLDNSDLYREDKDEKLKSKYT LFNDKDFKDRDYHKKYPTIHHL IMDLIEDEGKKDIRLLYLACHY LLKNRGHFIFEGQKFDTKNSFD KSINDLKIHLRDEYNIDLEFNN EDLIEIITDTTLNKTNKKKELK NIVGDTKFLKAISAIMIGSSQK LVDLFEDGEFEETTVKSVDFST TAFDDKYSEYEEALGDTISLLN ILKSIYDSSILENLLKDADKSK DGNKYISKAFVKKFNKHGKDLK TLKRIIKKYLPSEYANIFRNKS INDNYVAYTKSNITSNKRTKAS KFTKQEDFYKFIKKHLDTIKET KLNSSENEDLKLIDEMLTDIEF KTFIPKLKSSDNGVIPYQLKLM ELKKILDNQSKYYDFLNESDEY GTVKDKVESIMEFRIPYYVGPL NPDSKYAWIKRENTKITPWNFK DIVDLDSSREEFIDRLIGRCTY LKEEKVLPKASLIYNEFMVLNE LNNLKLNEFLITEEMKKAIFEE LFKTKKKVTLKAVSNLLKKEFN LTGDILLSGTDGDFKQGLNSYI DFKNIIGDKVDRDDYRIKIEEI IKLIVLYEDDKTYLKKKIKSAY KNDFTDDEIKKIAALNYKDWGR LSKRFLTGIEGVDKTTGEKGSI IYFMREYNLNLMELMSGHYTFT EEVEKLNPVENRELCYEMVDEL YLSPSVKRMLWQSLRVVDEIKR IIGKDPKKIFIEMARAKEAKNS RKESRKNKLLEFYKFGKKAFIN EIGEERYNYLLNEINSEEESKF RWDNLYLYYTQLGRCMYSLEPI DLADLKSNNIYDQDHIYPKSKI YDDSLENRVLVKKNLNHEKGNQ YPIPEKVLNKNAYGFWKILFDK GLIGQKKYTRLTRRTPFEEREL AEFIERQIVETRQATKETANLL KNICQDSEIVYSKAENASRFRQ EFDIIKCRTVNDLHHMHDAYLN IVVGNVYNTKFTKNPLNFIKDK DNVRSYNLENMFKYDVVRGSYT AWIADDSEGNVKAATIKKVKRE LEGKNYRFTRMSYIGTGGLYDQ NLMRKGKGQIPQKENTNKSNIE KYGGYNKASSAYFALIESDGKA GRERTLETIPIMVYNQEKYGNT EAVDKYLKDNLELQDPKILKDK IKINSLIKLDGFLYNIKGKTGD SLSIAGSVQLIVNKEEQKLIKK MDKFLVKKKDNKDIKVTSFDNI KEEELIKLYKTLSDKLNNGIYS NKRNNQAKNISEALDKFKEISI EEKIDVLNQIILLFQSYNNGCN LKSIGLSAKTGVVFIPKKLNYK ECKLINQSITGLFENEVDLLNL (SEQ ID NO: 20) | 171 | 311 | 141 | 535 | 615 | 76 | 535 | 615 | 76 |

TABLE 100-continued

Amino Acid Sequence of Cas9 Orthologs

| Species/ Composite ID | Amino acid sequence | REC2 | | | REC1$_{CT}$ | | | Rec$_{sub}$ | | |
|---|---|---|---|---|---|---|---|---|---|---|
| | | start (AA pos) | stop (AA pos) | # AA deleted (n) | start (AA pos) | stop (AA pos) | # AA deleted (n) | start (AA pos) | stop (AA pos) | # AA deleted (n) |
| *Acidaminococcus sp.* D21 gi\|227824983\| ref\| ZP_03989815.1 | MGKMYYLGLDIGTNSVGYAVTD PSYHLLKFKGEPMWGAHVFAAG NQSAERRSFRTSRRRLDRRQQR VKLVQEIFAPVISPIDPRFFIR LHESALWRDDVAETDKHIFFND PTYTDKEYYSDYPTIHHLIVDL MESSEKHDPRLVYLAVAWLVAH RGHFLNEVDKDNIGDVLSFDAF YPEFLAFLSDNGVSPWVCESKA LQATLLSRNSVNDKYKALKSLI FGSQKPEDNFDANISEDGLIQL LAGKKVKVNKLFPQESNDASFT LNDKEDAIEEILGTLTPDECEW IAHIRRLFDWAIMKHALKDGRT ISESKVKLYEQHHDLTQLKYF VKTYLAKEYDDIFRNVDSETTK NYVAYSYHVKEVKGTLPKNKAT QEEFCKYVLGKVKNIECSEADK VDFDEMIQRLTDNSFMPKQVSG ENRVIPYQLYYYELKTILNKAA SYLPFLTQCGKDAISNQDKLLS IMTFRIPYFVGPLRKDNSEHAW LERKAGKIYPWNFNDKVDLDKS EEAFIRRMTNTCTYYPGEDVLP LDSLIYEKFMILNEINNIRIDG YPISVDVKQQVFGLFEKKRRVT VKDIQNLLLSLGALDKHGKLTG IDTTIHSNYNTYHHFKSLMERG VLTRDDVERIVERMTYSDDTKR VRLWLNNNYGTLTADDVKHISR LRKHDFGRLSKMFLTGLKGVHK ETGERASILDFMWNTNDNLMQL LSECYTFSDEITKLQEAYYAKA QLSLNDFLDSMYISNAVKRPIY RTLAVVNDIRKACGTAPKRIFI EMARDGESKKKRSVTRREQIKN LYRSIRKDFQQEVDFLEKILEN KSDGQLQSDALYLYFAQLGRDM YTGDPIKLEHIKDQSFYNIDHI YPQSMVKDDSLDNKVLVQSEIN GEKSSRYPLDAAIRNKMKPLWD AYYNHGLISLKKYQRLTRSTPF TDDEKWDFINRQLVETRQSTKA LAILLKRKFPDTEIVYSKAGLS SDFRHEFGLVKSRNINDLHHAK DAFLAIVTGNVYHERFNRRWFM VNQPYSVKTKTLFTHSIKNGNF VAWNGEEDLGRIVKMLKQNKNT IHFTRFSFDRKEGLFDIQPLKA STGLVPRKAGLDVVKYGGYDKS TAAYYLLVRFTLEDKKTQHKLM MIPVEGLYKARIDHDKEFLTDY AQTTISEILQKDKQKVINIMFP MGTRHIKLNSMISIDGFYLSIG GKSSKGKSVLCHAMVPLIVPHK IECYIKAMESFARKFKENNKLR IVEKFDKITVEDNLNLYELFLQ KLQHNPYNKFFSTQFDVLINGR STFTKLSPEEQVQTLLNILSIF KTCRSSGCDLKSINGSAQAARI MISADLTGLSKKYSDIRLVEQS ASGLFVSKSQNLLEYL (SEQ ID NO: 21) | 167 | 306 | 140 | 511 | 591 | 75 | 511 | 591 | 75 |
| *Lactobacillus farciminis* KCTC 3681 gi\|336394882\| ref\| ZP_08576281.1 | MTKKEQPYNIGLDIGTSSVGWA VTNDNYDLLNIKKKNLWGVRLF EEAQTAKETRLNRSTRRRYRRR KNRINWLNEIFSEELAKTDPSF LIRLQNSWVSKKDPDRKRDKYN LFIDGPYTDKEYREFPTIFHL RKELILNKDKADIRLIYALHN ILKYRGNFTYEHQKFNISNLNN | 171 | 310 | 140 | 542 | 621 | 85 | 542 | 621 | 85 |

TABLE 100-continued

Amino Acid Sequence of Cas9 Orthologs

| Species/ Composite ID | Amino acid sequence | REC2 start (AA pos) | REC2 stop (AA pos) | REC2 # AA deleted (n) | REC1$_{CT}$ start (AA pos) | REC1$_{CT}$ stop (AA pos) | REC1$_{CT}$ # AA deleted (n) | Rec$_{sub}$ start (AA pos) | Rec$_{sub}$ stop (AA pos) | Rec$_{sub}$ # AA deleted (n) |
|---|---|---|---|---|---|---|---|---|---|---|
| | NLSKELIELNQQLIKYDISFPD DCDWNHISDILIGRGNATQKSS NILKDFTLDKETKKLLKEVINL ILGNVAHLNTIFKTSLTKDEEK LNFSGKDIESKLDDLDSILDDD QFTVLDAANRIYSTITLNEILN GESYFSMAKVNQYENHAIDLCK LRDMWHTTKNEEAVEQSRQAYD DYINKPKYGTKELYTSLKKFLK VALPTNLAKEAEEKISKGTYLV KPRNSENGVVPYQLNKIEMEKI IDNQSQYYPFLKENKEKLLSIL SFRIPYYVGPLQSAEKNPFAWM ERKSNGHARPWNFDEIVDREKS SNKFIRRMTVTDSYLVGEPVLP KNSLIYQRYEVLNELNNIRITE NLKTNPIGSRLTVETKQRIYNE LFKKYKKVTVKKLTKWLIAQGY YKNPILIGLSQKDEFNSTLTTY LDMKKIFGSSFMEDNKNYDQIE ELIEWLTIFEDKQILNEKLHSS KYSYTPDQIKKISNMRYKGWGR LSKKILMDITTETNTPQLLQLS NYSILDLMWATNNNFISIMSND KYDFKNYIENHNLNKNEDQNIS DLVNDIHVSPALKRGITQSIKI VQEIVKFMGHAPKHIFIEVTRE TKKSEITTSREKRIKRLQSKLL NKANDFKPQLREYLVPNKKIQE ELKKHKNDLSSERIMLYFLQNG KSLYSEESLNINKLSDYQVDHI LPRTYIPDDSLENKALVLAKEN QRKADDLLLNSNVIDRNLERWT YMLNNNMIGLKKFKNLTRRVIT DKDKLGFIHRQLVQTSQMVKGV ANILDNMYKNQGTTCIQARANL STAFRKALSGQDDTYHFKHPEL VKNRNVNDFHHAQDAYLASFLG TYRLRRFPTNEMLLMNGEYNKF YGQVKELYSKKKKLPDSRKNGF IISPLVNGTTQYDRNTGEIIWN VGFRDKILKIFNYHQCNVTRKT EIKTGQFYDQTIYSPKNPKYKK LIAQKKDMDPNIYGGFSGDNKS SITIVKIDNNKIKPVAIPIRLI NDLKDKKTLQNWLEENVKHKKS IQIIKNNVPIGQIIYSKKVGLL SLNSDREVANRQQLILPPEHSA LLRLLQIPDEDLDQILAFYDKN ILVEILQELITKMKKFYPFYKG EREFLIANIENFNQATTSEKVN SLEELITLLHANSTSAHLIFNN IEKKAFGRKTHGLTLNNTDFIY QSVTGLYETRIHIE (SEQ ID NO: 22) | | | | | | | | | |
| Streptococcus sanguinis SK49 gi\|422884106\| ref\| ZP_16930555.1 | MTKFNKNYSIGLDIGVSSVGYA VVTEDYRVPAFKFKVLGNTEKE KIKKNLIGSTTFVSAQPAKGTR VFRVNRRIDRRNHRITYLRDI FQKEIEKVDKNFYRRLDESFRV LGDKSEDLQIKQPFFGDKELET AYHKKYPTIYHLRKHLADADKN SPVADIREVYMAISHILKYRGH FLTLDKINPNNINMQNSWIDFI ESCQEVEDLEISDESKNIADIF KSSENRQEKVKKILPYFQQELL KKDKSIFKQLLQLLFGLKTKFK DCFELEEEPDLNFSKENYDENL ENFLGSLEEDFSDVFAKLKVLR DTILLSGMLTYTGATHARFSAT MVERYEEHRKDLQRFKFFIKQN | 185 | 324 | 140 | 411 | 490 | 85 | 411 | 490 | 85 |

TABLE 100-continued

Amino Acid Sequence of Cas9 Orthologs

| Species/ Composite ID | Amino acid sequence | REC2 | | | REC1$_{CT}$ | | | Rec$_{sub}$ | | |
|---|---|---|---|---|---|---|---|---|---|---|
| | | start (AA pos) | stop (AA pos) | # AA deleted (n) | start (AA pos) | stop (AA pos) | # AA deleted (n) | start (AA pos) | stop (AA pos) | # AA deleted (n) |
| | LSEQDYLDIFGRKTQNGFDVDK ETKGYVGYITNKMVLTNPQKQK TIQQNFYDYISGKITGIEGAEY FLNKISDGTFLRKLRTSDNGAI PNQIHAYELEKIIERQGKDYPF LLENKDKLLSILTFKIPYYVGP LAKGSNSRFAWIKRATSSDILD DNDEDTRNGKIRPWNYQKLINM DETRDAFITNLIGNDIILLNEK VLPKRSLIYEEVMLQNELTRVK YKDKYGKAHFFDSELRQNIING LFKNNSKRVNAKSLIKYLSDNH KDLNAIEIVSGVEKGKSFNSTL KTYNDLKTIFSEELLDSEIYQK ELEEIIKVITVFDDKKSIKNYL TKFFGHLEILDEEKINQLSKLR YSGWGRYSAKLLLDIRDEDTGF NLLQFLRNDEENRNLTKLISDN TLSFEPKIKDIQSKSTIEDDIF DEIKKLAGSPAIKRGILNSIKI VDELVQIIGYPPHNIVIEMARE NMTTEEGQKKAKTRKTKLESAL KNIENSLLENGKVPHSDEQLQS EKLYLYYLQNGKDMYTLDKTGS PAPLYLDQLDQYEVDHIIPYSF LPIDSIDNKVLTHRENNQQKLN NIPDKETVANMKPFWEKLYNAK LISQTKYQRLTTSERTPDGVLT ESMKAGFIERQLVETRQIIKHV ARILDNRFSDTKIITLKSQLIT NFRNTFHIAKIRELNDYHHAHD AYLAVVVGQTLLKVYPKLAPEL IYGHHAHFNRHEENKATLRKHL YSNIMRFFNNPDSKVSKDIWDC NRDLPIIKDVIYNSQINFVKRT MIKKGAFYNQNPVGKFNKQLAA NNRYPLKTKALCLDTSIYGGYG PMNSALSIIIAERFNEKKGKI ETVKEFHDIFIIDYEKFNNNPF QFLNDTSENGFLKKNNINRVLG FYRIPKYSLMQKIDGTRMLFES KSNLHKATQFKLTKTQNELFFH MKRLLTKSNLMDLKSKSAIKES QNFILKHKEEFDNISNQLSAFS QKMLGNTTSLKNLIKGYNERKI KEIDIRDETIKYFYDNFIKMFS FVKSGAPKDINDFFDNKCTVAR MRPKPDKKLLNATLIHQSITGL YETRIDLSKLGED (SEQ ID NO: 23) | | | | | | | | | |
| Coprococcus catus GD-7 gi\|291520705\| emb\|CBK78998.1\| | MKQEYFLGLDMGTGSLGWAVTD STYQVMRKHGKALWGTRLFESA STAEERRMFRTARRRLDRRNWR IQVLQEIFSEEISKVDPGFFLR MKESKYYPEDKRDAEGNCPELP YALFVDDNYTDKNYHKDYPTIY HLRKMLMETTEIPDIRLVYLVL HHMMKHRGHFLLSGDISQIKEF KSTFEQLIQNIQDEELEWHISL DDAAIQFVEHVLKDRNLTRSTK KSRLIKQLNAKSACEKAILNLL SGGTVKLSDIFNNKELDESERP KVSFADSGYDDYIGIVEAELAE QYYIIASAKAVYDWSVLVEILG NSVSISEAKIKVYQKHQADLKT LKKIVRQYMTKEDYKRVFVDTE EKLNNYSAYIGMTKKNGKKVDL KSKQCTQADFYDFLKKNVIKVI DHKEITQEIESEIEKENFLPKQ VTKDNGVIPYQVHDYELKKILD NLGTRMPFIKENAEKIQQLFEF | 172 | 310 | 139 | 556 | 634 | 76 | 556 | 634 | 76 |

TABLE 100-continued

Amino Acid Sequence of Cas9 Orthologs

| Species/ Composite ID | Amino acid sequence | REC2 | | | REC1$_{CT}$ | | | Rec$_{sub}$ | | |
|---|---|---|---|---|---|---|---|---|---|---|
| | | start (AA pos) | stop (AA pos) | # AA deleted (n) | start (AA pos) | stop (AA pos) | # AA deleted (n) | start (AA pos) | stop (AA pos) | # AA deleted (n) |
| | RIPYYVGPLNRVDDGKDGKFTW SVRKSDARIYPWNFTEVIDVEA SAEKFIRRMTNKCTYLVGEDVL PKDSLVYSKFMVLNELNNLRLN GEKISVELKQRIYEELFCKYRK VTRKKLERYLVIEGIAKKGVEI TGIDGDFKASLTAYHDFKERLT DVQLSQRAKEAIVLNVVLFGDD KKLLKQRLSKMYPNLTTGQLKG ICSLSYQGWGRLSKTFLEEITV PAPGTGEVWNIMTALWQTNDNL MQLLSRNYGFTNEVEEFNTLKK ETDLSYKTVDELYVSPAVKRQI WQTLKVVKEIQKVMGNAPKRVF VEMAREKQEGKRSDSRKKQLVE LYRACKNEERDWITELNAQSDQ QLRSDKLFLYYIQKGRCMYSGE TIQLDELWDNTKYDIDHIYPQS KTMDDSLNNRVLVKKNYNAIKS DTYPLSLDIQKKMMSFWKMLQQ QGFITKEKYVRLVRSDELSADE LAGFIERQIVETRQSTKAVATI LKEALPDTEIVYVKAGNVSNFR QTYELLKVREMNDLHHAKDAYL NIVVGNAYFVKFTKNAAWFIRN NPGRSYNLKRMFEFDIERSGEI AWKAGNKGSIVTVKKVMQKNNI LVTRKAYEVKGGLFDQQIMKKG KGQVPIKGNDERLADIEKYGGY NKAAGTYFMLVKSLDKKGKEIR TIEFVPLYLKNQIEINHESAIQ YLAQERGLNSPEILLSKIKIDT LFKVDGFKMWLSGRTGNQLIFK GANQLILSHQEAAILKGVVKYV NRKNENKDAKLSERDGMTEEKL LQLYDTFLDKLSNTVYSIRLSA QIKTLTEKRAKFIGLSNEDQCI VLNEILHMFQCQSGSANLKLIG GPGSAGILVMNNNITACKQISV INQSPTGIYEKEIDLIKL (SEQ ID NO: 24) | | | | | | | | | |
| Streptococcus mutans UA159 gi\|24379809\| ref\|NP_721764.1\| | MKKPYSIGLDIGTNSVGWAVVT DDYKVPAKKMKVLGNTDKSHIE KNLLGALLFDSGNTAEDRRLKR TARRRYTRRRNRILYLQEIFSE EMGKVDDSFFHRLEDSFLVTED KRGERHPIFGNLEEEVKYHENF PTIYHLRQYLADNPEKVDLRLV YLALAHIIKFRGHFLIEGKFDT RNNDVQRLFQEFLAVYDNTFEN SSLQEQNVQVEEILTDKISKSA KKDRVLKLFPNEKSNGRFAEFL KLIVGNQADFKKHFELEEKAPL QFSKDTYEEELEVLLAQIGDNY AELFLSAKKLYDSILLSGILTV TDVGTKAPLSASMIQRYNEHQM DLAQLKQFIRQKLSDKYNEVFS DVSKDGYAGYIDGKTNQEAFYK YLKGLLNKIEGSGYFLDKIERE DFLRKQRTFDNGSIPHQIHLQE MRAIIRRQAEFYPFLADNQDRI EKLLTFRIPYYVGPLARGKSDF AWLSRKSADKITPWNFDEIVDK ESSAEAFINRMTNYDLYLPNQK VLPKHSLLYEKFTVYNELTKVK YKTEQGKTAFFDANMKQEIFDG VFKVYRKVTKDKLMDFLEKEFD EFRIVDLTGLDKENKVFNASYG TYHDLCKILDKDFLDNSKNEKI LEDIVLTLTLFEDREMIRKRLE NYSDLLTKEQVKKLERRHYTGW | 176 | 314 | 139 | 392 | 470 | 84 | 392 | 470 | 84 |

TABLE 100-continued

Amino Acid Sequence of Cas9 Orthologs

| Species/ Composite ID | Amino acid sequence | REC2 start (AA pos) | REC2 stop (AA pos) | REC2 # AA deleted (n) | REC1$_{CT}$ start (AA pos) | REC1$_{CT}$ stop (AA pos) | REC1$_{CT}$ # AA deleted (n) | Rec$_{sub}$ start (AA pos) | Rec$_{sub}$ stop (AA pos) | Rec$_{sub}$ # AA deleted (n) |
|---|---|---|---|---|---|---|---|---|---|---|
| | GRLSAELIHGIRNKESRKTILD YLIDDGNSNRNFMQLINDDALS FKEEIAKAQVIGETDNLNQVVS DIAGSPAIKKGILQSLKIVDEL VKIMGHQPENIVVEMARENQFT NQGRRNSQQRLKGLTDSIKEFG SQILKEHPVENSQLQNDRLFLY YLQNGRDMYTGEELDIDYLSQY DIDHIIPQAFIKDNSIDNRVLT SSKENRGKSDDVPSKDVVRKMK SYWSKLLSAKLITQRKFDNLTK AERGGLTDDDKAGFIKRQLVET RQITKHVARILDERENTETDEN NKKIRQVKIVTLKSNLVSNFRK EFELYKVREINDYHHAHDAYLN AVIGKALLGVYPQLEPEFVYGD YPHFHGHKENKATAKKFFYSNI MNFFKKDDVRTDKNGEIIWKKD EHISNIKKVLSYPQVNIVKKVE EQTGGFSKESILPKGNSDKLIP RKTKKFYWDTKKYGGFDSPIVA YSILVIADIEKGKSKKLKTVKA LVGVTIMEKMTFERDPVAFLER KGYRNVQEENIIKLPKYSLFKL ENGRKRLLASARELQKGNEIVL PNHLGTLLYHAKNIHKVDEPKH LDYVDKHKDEFKELLDVVSNFS KKYTLAEGNLEKIKELYAQNNG EDLKELASSFINLLTFTAIGAP ATFKFFDKNIDRKRYTSTTEIL NATLIHQSITGLYETRIDLNKL GGD (SEQ ID NO: 25) | | | | | | | | | |
| Streptococcus pyogenes M1 GAS gi\|13622193\| gb\|AAK33936.1\| | MDKKYSIGLDIGTNSVGWAVIT DEYKVPSKKFKVLGNTDRHSIK NLIGALLFDSGETAEATRLKR TARRRYTRRKNRICYLQEIFSN EMAKVDDSFFHRLEESFLVEED KKHERHPIFGNIVDEVAYHEKY PTIYHLRKKLVDSTDKADLRLI YLALAHMIKFRGHFLIEGDLNP DNSDVDKLFIQLVQTYNQLFEE NPINASGVDAKAILSARLSKSR RLENLIAQLPGEKKNGLFGNLI ALSLGLTPNFKSNFDLAEDAKL QLSKDTYDDDLDNLLAQIGDQY ADLFLAAKNLSDAILLSDILRV NTEITKAPLSASMIKRYDEHHQ DLTLLKALVRQQLPEKYKEIFF DQSKNGYAGYIDGGASQEEFYK FIKPILEKMDGTEELLVKLNRE DLLRKQRTFDNGSIPHQIHLGE LHAILRRQEDFYPFLKDNREKI EKILTFRIPYYVGPLARGNSRF AWMTRKSEETITPWNFEEVVDK GASAQSFIERMTNFDKNLPNEK VLPKHSLLYEYFTVYNELTKVK YVTEGMRKPAFLSGEQKKAIVD LLFKTNRKVTVKQLKEDYFKKI ECFDSVEISGVEDRFNASLGTY HDLLKIIKDKDFLDNEENEDIL EDIVLTLTLFEDREMIEERLKT YAHLFDDKVMKQLKRRRYTGWG RLSRKLINGIRDKQSGKTILDF LKSDGFANRNFMQLIHDDSLTF KEDIQKAQVSGQGDSLHEHIAN LAGSPAIKKGILQTVKVVDELV KVMGRHKPENIVIEMARENQTT QKGQKNSRERMKRIEEGIKELG SQILKEHPVENTQLQNEKLYLY YLQNGRDMYVDQELDINRLSDY DVDHIVPQSFLKDDSIDNKVLT | 176 | 314 | 139 | 523 | 600 | 82 | 523 | 600 | 82 |

TABLE 100-continued

Amino Acid Sequence of Cas9 Orthologs

| | | REC2 | | | REC1$_{CT}$ | | | Rec$_{sub}$ | | |
|---|---|---|---|---|---|---|---|---|---|---|
| Species/<br>Composite<br>ID | Amino acid sequence | start<br>(AA<br>pos) | stop<br>(AA<br>pos) | # AA<br>deleted<br>(n) | start<br>(AA<br>pos) | stop<br>(AA<br>pos) | # AA<br>deleted<br>(n) | start<br>(AA<br>pos) | stop<br>(AA<br>pos) | # AA<br>deleted<br>(n) |
| | RSDKNRGKSDNVPSEEVVKKMK<br>NYWRQLLNAKLITQRKFDNLTK<br>AERGGLSELDKAGFIKRQLVET<br>RQITKHVAQILDSRMNTKYDEN<br>DKLIREVKVITLKSKLVSDERK<br>DFQFYKVREINNYHHAHDAYLN<br>AVVGTALIKKYPKLESEFVYGD<br>YKVYDVRKMIAKSEQEIGKATA<br>KYFFYSNIMNFFKTEITLANGE<br>IRKRPLIETNGETGEIVWDKGR<br>DFATVRKVLSMPQVNIVKKTEV<br>QTGGFSKESILPKRNSDKLIAR<br>KKDWDPKKYGGFDSPTVAYSVL<br>VVAKVEKGKSKKLKSVKELLGI<br>TIMERSSFEKNPIDFLEAKGYK<br>EVKKDLIIKLPKYSLFELENGR<br>KRMLASAGELQKGNELALPSKY<br>VNFLYLASHYEKLKGSPEDNEQ<br>KQLFVEQHKHYLDEIIEQISEF<br>SKRVILADANLDKVLSAYNKHR<br>DKPIREQAENIIHLFTLTNLGA<br>PAAFKYFDTTIDRKRYTSTKEV<br>LDATLIHQSITGLYETRIDLSQ<br>LGGD (SEQ ID NO: 26) | | | | | | | | | |
| *Streptococcus<br>thermophilus*<br>LMD-9<br>gi\|116628213\|<br>ref\|YP_820832.1\| | MTKPYSIGLDIGTNSVGWAVTT<br>DNYKVPSKKMKVLGNTSKKYIK<br>KNLLGVLLFDSGITAEGRRLKR<br>TARRRYTRRRNRILYLQEIFST<br>EMATLDDAFFQRLDDSFLVPDD<br>KRDSKYPIFGNLVEEKAYHDEF<br>PTIYHLRKYLADSTKKADLRLV<br>YLALAHMIKYRGHFLIEGEFNS<br>KNNDIQKNFQDFLDTYNAIFES<br>DLSLENSKQLEEIVKDKISKLE<br>KKDRILKLFPGEKNSGIFSEFL<br>KLIVGNQADFRKCFNLDEKASL<br>HFSKESYDEDLETLLGYIGDDY<br>SDVFLKAKKLYDAILLSGFLTV<br>TDNETEAPLSSAMIKRYNEHKE<br>DLALLKEYIRNISLKTYNEVFK<br>DDTKNGYAGYIDGKTNQEDFYV<br>YLKKLLAEFEGADYFLEKIDRE<br>DFLRKQRTFDNGSIPYQIHLQE<br>MRAILDKQAKFYPFLAKNKERI<br>EKILTFRIPYYVGPLARGNSDF<br>AWSIRKRNEKITPWNFEDVIDK<br>ESSAEAFINRMTSFDLYLPEEK<br>VLPKHSLLYETFNVYNELTKVR<br>FIAESMRDYQFLDSKQKKDIVR<br>LYFKDKRKVTDKDIIEYLHAIY<br>GYDGIELKGIEKQFNSSLSTYH<br>DLLNIINDKEFLDDSSNEAIIE<br>EIIHTLTIFEDREMIKQRLSKF<br>ENIFDKSVLKKLSRRHYTGWGK<br>LSAKLINGIRDEKSGNTILDYL<br>IDDGISNRNFMQLIHDDALSFK<br>KKIQKAQIIGDEDKGNIKEVVK<br>SLPGSPAIKKGILQSIKIVDEL<br>VKVMGGRKPESIVVEMARENQY<br>TNQGKSNSQQRLKRLEKSLKEL<br>GSKILKENIPAKLSKIDNNALQ<br>NDRLYLYYLQNGKDMYTGDDLD<br>IDRLSNYDIDHIIPQAFLKDNS<br>IDNKVLVSSASNRGKSDDVPSL<br>EVVKKRKTFWYQLLKSKLISQR<br>KFDNLTKAERGGLSPEDKAGFI<br>QRQLVETRQITKHVARLLDEKF<br>NNKKDENNRAVRTVKIITLKST<br>LVSQFRKDFELYKVREINDFHH<br>AHDAYLNAVVASALLKKYPKLE<br>PEFVYGDYPKYNSFRERKSATE | 176 | 314 | 139 | 481 | 558 | 81 | 481 | 558 | 81 |

TABLE 100-continued

Amino Acid Sequence of Cas9 Orthologs

| | | REC2 | | | REC1$_{CT}$ | | | Rec$_{sub}$ | | |
|---|---|---|---|---|---|---|---|---|---|---|
| Species/ Composite ID | Amino acid sequence | start (AA pos) | stop (AA pos) | # AA deleted (n) | start (AA pos) | stop (AA pos) | # AA deleted (n) | start (AA pos) | stop (AA pos) | # AA deleted (n) |
| | KVYFYSNIMNIFKKSISLADGR VIERPLIEVNEETGESVWNKES DLATVRRVLSYPQVNVVKKVEE QNHGLDRGKPKGLFNANLSSKP KPNSNENLVGAKEYLDPKKYGG YAGISNSFTVLVKGTIEKGAKK KITNVLEFQGISILDRINYRKD KLNFLLEKGYKDIELIIELPKY SLFELSDGSRRMLASILSTNNK RGEIHKGNQIFLSQKFVKLLYH AKRISNTINENHRKYVENHKKE FEELFYYILEFNENYVGAKKNG KLLNSAFQSWQNHSIDELCSSF IGPTGSERKGLFELTSRGSAAD FEFLGVKIPRYRDYTPSSLLKD ATLIHQSVTGLYETRIDLAKLG EG (SEQ ID NO: 27) | | | | | | | | | |
| Fusobacterium nucleatum ATCC49256 gi\|34762592\| ref\| ZP_00143587.1\| | MKKQKFSDYYLGFDIGTNSVGW CVTDLDYNVLRFNKKDMWGSRL FDEAKTAAERRVQRNSRRRLKR RKWRLNLLEEIFSDEIMKIDSN FFRRLKESSLWLEDKNSKEKFT LFNDDNYKDYDFYKQYPTIFHL RDELIKNPEKKDIRLIYLALHS IFKSRGHFLFEGQNLKEIKNFE TLYNNLISFLEDNGINKSIDKD NIEKLEKIICDSGKGLKDKEKE FKGIFNSDKQLVAIFKLSVGSS VSLNDLFDTDEYKKEEVEKEKI SFREQIYEDDKPIYYSILGEKI ELLDIAKSFYDFMVLNNILSDS NYISEAKVKLYEEHKKDLKNLK YIIRKYNKENYDKLFKDKNENN YPAYIGLNKEKDKKEVVEKSRL KIDDLIKVIKGYLPKPERIEEK DKTIFNEILNKIELKTILPKQR ISDNGTLPYQIHEVELEKILEN QSKYYDFLNYEENGVSTKDKLL KTFKFRIPYYVGPLNSYHKDKG GNSWIVRKEEGKILPWNFEQKV DIEKSAEEFIKRMTNKCTYLNG EDVIPKDSFLYSEYIILNELNK VQVNDEFLNEENKRKIIDELFK ENKKVSEKKFKEYLLVNQIANR TVELKGIKDSFNSNYVSYIKFK DIFGEKLNLDIYKEISEKSILW KCLYGDDKKIFEKKIKNEYGDI LNKDEIKKINSFKENTWGRLSE KLLTGIEFINLETGECYSSVME ALRRTNYNLMELLSSKFTLQES IDNENKEMNEVSYRDLIEESYV SPSLKRAILQTLKIYEEIKKIT GRVPKKVFIEMARGGDESMKNK KIPARQEQLKKLYDSCGNDIAN FSIDIKEMKNSLSSYDNNSLRQ KKLYLYYLQFGKCMYTGREIDL DRLLQNNDTYDIDHIYPRSKVI KDDSFDNLVLVKNENAEKSNE YPVKKEIQEKMKSFWRFLKEKN FISDEKYKRLTGKDDFELRGFM ARQLVNVRQTTKEVGKILQQIE PEIKIVYSKAEIASSFREMFDF IKVRELNDTHHAKDAYLNIVAG NVYNTKFTEKPYRYLQEIKENY DVKKIYNYDIKNAWDKENSLEI VKKNMEKNTVNITRFIKEEKGE LFNLNPIKKGETSNEIISIKPK LYDGKDNKLNEKYGYYTSLKAA YFIYVEHEKKNKKVKTFERITR IDSTLIKNEKNLIKYLVSQKKL LNPKIIKKIYKEQTLIIDSYPY | 171 | 308 | 138 | 537 | 614 | 76 | 537 | 614 | 76 |

TABLE 100-continued

Amino Acid Sequence of Cas9 Orthologs

| Species/ Composite ID | Amino acid sequence | REC2 start (AA pos) | REC2 stop (AA pos) | REC2 # AA deleted (n) | REC1$_{CT}$ start (AA pos) | REC1$_{CT}$ stop (AA pos) | REC1$_{CT}$ # AA deleted (n) | Rec$_{sub}$ start (AA pos) | Rec$_{sub}$ stop (AA pos) | Rec$_{sub}$ # AA deleted (n) |
|---|---|---|---|---|---|---|---|---|---|---|
| | TFTGVDSNKKVELKNKKQLYLE KKYEQILKNALKFVEDNQGETE ENYKFIYLKKRNNNEKNETIDA VKERYNIEFNEMYDKFLEKLSS KDYKNYINNKLYTNFLNSKEKF KKLKLWEKSLILREFLKIFNKN TYGKYEIKDSQTKEKLFSFPED TGRIRLGQSSLGNNKELLEESV TGLFVKKIKL (SEQ ID NO: 28) | | | | | | | | | |
| Planococcus antarcticus DSM 14505 gi\|389815359\| ref\| ZP_10206685.1 | MKNYTIGLDIGVASVGWVCIDE NYKILNYNNRHAFGVHEFESAE SAAGRRLKRGMRRRYNRRKKRL QLLQSLFDSYITDSGFFSKTDS QHFWKNNNEFENRSLTEVLSSL RISSRKYPTIYHLRSDLIESNK KMDLRLVYLALHNLVKYRGHFL QEGNWSEAASAEGMDDQLLELV TRYAELENLSPLDLSESQWKAA ETLLLNRNLTKTDQSKELTAMF GKEYEPFCKLVAGLGVSLHQLF PSSEQALAYKETKTKVQLSNEN VEEVMELLLEEESALLEAVQPF YQQVVLYELLKGETYVAKAKVS AFKQYQKDMASLKNLLDKTFGE KVYRSYFISDKNSQREYQKSHK VEVLCKLDQFNKEAKFAETFYK DLKKLLEDKSKTSIGTTEKDEM LRIIKAIDSNQFLQKQKGIQNA AIPHQNSLYEAEKILRNQQAHY PFITTEWIEKVKQILAFRIPYY IGPLVKDTTQSPFSWVERKGDA PITPWNFDEQIDKAASAEAFIS RMRKTCTYLKGQEVLPKSSLTY ERFEVLNELNGIQLRTTGAESD FRHRLSYEMKCWIIDNVFKQYK TVSTKRLLQELKKSPYADELYD EHTGEIKEVFGTQKENAFATSL SGYISMKSILGAVVDDNPAMTE ELIYWIAVFEDREILHLKIQEK YPSITDVQRQKLALVKLPGWGR FSRLLIDGLPLDEQGQSVLDHM EQYSSVFMEVLKNKGFGLEKKI QKMNQHQVDGTKKIRYEDIEEL AGSPALKRGIWRSVKIVEELVS IFGEPANIVLEVAREDGEKKRT KSRKDQWEELTKTTLKNDPDLK SFIGEIKSQGDQRFNEQRFWLY VTQQGKCLYTGKALDIQNLSMY EVDHILPQNFVKDDSLDNLALV MPEANQRKNQVGQNKMPLEIIE ANQQYAMRTLWERLHELKLISS GKLGRLKKPSFDEVDKDKFIAR QLVETRQIIKHVRDLLDERFSK SDIHLVKAGIVSKFRRFSEIPK IRDYNNKHHAMDALFAAALIQS ILGKYGKNFLAFDLSKKDRQKQ WRSVKGSNKEFFLFKNFGNLRL QSPVTGEEVSGVEYMKHVYFEL PWQTTKMTQTGDGMFYKESIFS | 162 | 299 | 138 | 538 | 614 | 94 | 538 | 614 | 94 |

TABLE 100-continued

Amino Acid Sequence of Cas9 Orthologs

| Species/ Composite ID | Amino acid sequence | REC2 start (AA pos) | REC2 stop (AA pos) | REC2 # AA deleted (n) | REC1_CT start (AA pos) | REC1_CT stop (AA pos) | REC1_CT # AA deleted (n) | Rec_sub start (AA pos) | Rec_sub stop (AA pos) | Rec_sub # AA deleted (n) |
|---|---|---|---|---|---|---|---|---|---|---|
| | PKVKQAKYVSPKTEKFVHDEVK NHSICLVEFTFMKKEKEVQETK FIDLKVIEHHQFLKEPESQLAK FLAEKETNSPIIHARIIRTIPK YQKIWIEHFPYYFISTRELHNA RQFEISYELMEKVKQLSERSSV EELKIVFGLLIDQMNDNYPIYT KSSIQDRVQKFVDTQLYDFKSF EIGFEELKKAVAANAQRSDTFG SRISKKPKPEEVAIGYESITGL KYRKPRSVVGTKR (SEQ ID NO: 29) | | | | | | | | | |
| Treponema denticola ATCC 35405 gi\|42525843\| ref\|NP_970941.1\| | MKKEIKDYFLGLDVGTGSVGWA VTDTDYKLLKANRKDLWGMRCF ETAETAEVRRLHRGARRRIERR KKRIKLLQELFSQEIAKTDEGF FQRMKESPFYAEDKTILQENTL FNDKDFADKTYHKAYPTINHLI KAWIENKVKPDPRLLYLACHNI IKKRGHFLFEGDFDSENQFDTS IQALFEYLREDMEVDIDADSQK VKEILKDSSLKNSEKQSRLNKI LGLKPSDKQKKAITNLISGNKI NFADLYDNPDLKDAEKNSISFS KDDFDALSDDLASILGDSFELL LKAKAVYNCSVLSKVIGDEQYL SFAKVKIYEKHKTDLTKLKNVI KKHFPKDYKKVFGYNKNEKNNN NYSGYVGVCKTKSKKLIINNSV NQEDFYKFLKTILSAKSEIKEV NDILTEIETGTFLPKQISKSNA EIPYQLRKMELEKILSNAEKHF SFLKQKDEKGLSHSEKIIMLLT FKIPYYIGPINDNHKKFFPDRC WVVKKEKSPSGKTTPWNFFDHI DKEKTAEAFITSRTNFCTYLVG ESVLPKSSLLYSEYTVLNEINN LQIIIDGKNICDIKLKQKIYED LFKKYKKITQKQISTFIKHEGI CNKTDEVIILGIDKECTSSLKS YIELKNIFGKQVDEISTKNMLE EIIRWATIYDEGEGKTILKTKI KAEYGKYCSDEQIKKILNLKFS GWGRLSRKFLETVTSEMPGFSE PVNIITAMRETQNNLMELLSSE FTFTENIKKINSGFEDAEKQFS YDGLVKPLFLSPSVKKMLWQTL KLVKEISHITQAPPKKIFIEMA KGAELEPARTKTRLKILQDLYN NCKNDADAFSSEIKDLSGKIEN EDNLRLRSDKLYLYYTQLGKCM YCGKPIEIGHVEDTSNYDIDHI YPQSKIKDDSISNRVLVCSSCN KNKEDKYPLKSEIQSKQRGFWN FLQRNNFISLEKLNRLTRATPI SDDETAKFIARQLVETRQATKV AAKVLEKMFPETKIVYSKAETV SMFRNKFDIVKCREINDFHHAH DAYLNIVVGNVYNTKFTNNPWN FIKEKRDNPKIADTYNYYKVFD YDVKRNNITAWEKGKTIITVKD MLKRNTPIYTRQAACKKGELEN QTIMKKGLGQHPLKKEGPFSNI SKYGGYNKVSAAYYTLIEYEEK GNKIRSLETIPLYLVKDIQKDQ DVLKSYLTDLLGKKEFKILVPK IKINSLLKINGFPCHITGKIND SFLLRPAVQFCCSNNEVLYFKK IIRFSEIRSQREKIGKTISPYE DLSFRSYIKENLWKKTKNDEIG EKEFYDLLQKKNLEIYDMLLTK | 169 | 305 | 137 | 524 | 600 | 81 | 524 | 600 | 81 |

TABLE 100-continued

Amino Acid Sequence of Cas9 Orthologs

| Species/ Composite ID | Amino acid sequence | REC2 start (AA pos) | REC2 stop (AA pos) | REC2 # AA deleted (n) | REC1_CT start (AA pos) | REC1_CT stop (AA pos) | REC1_CT # AA deleted (n) | Rec_sub start (AA pos) | Rec_sub stop (AA pos) | Rec_sub # AA deleted (n) |
|---|---|---|---|---|---|---|---|---|---|---|
| | HKDTIYKKRPNSATIDILVKGK EKFKSLIIENQFEVILEILKLF SATRNVSDLQHIGGSKYSGVAK IGNKISSLDNCILIYQSITGIF EKRIDLLKV (SEQ ID NO: 30) | | | | | | | | | |
| Solobacterium moorei F0204 gi\|320528778\| ref\| ZP_08029929.1 | MEGQMKNNGNNLQQGNYYLGLD VGTSSVGWAVTDTDYNVLKFRG KSMWGARLFDEASTAEERRTHR GNRRRLARRKYRLLLLEQLFEK EIRKIDDNFFVRLHESNLWADD KSKPSKFLLFNDTNFTDKDYLK KYPTIYHLRSDLIHNSTEHDIR LVFLALHHLIKYRGHFIYDNSA NGDVKTLDEAVSDFEEYLNEND IEFNIENKKEFINVLSDKHLTK KEKKISLKKLYGDITDSENINI SVLIEMLSGSSISLSNLFKDIE FDGKQNLSLDSDIEETLNDVVD ILGDNIDLLIHAKEVYDIAVLT SSLGKHKYLCDAKVELFEKNKK DLMILKKYIKKNHPEDYKKIFS SPTEKKNYAAYSQTNSKNVCSQ EEFCLFIKPYIRDMVKSENEDE VRIAKEVEDKSFLTKLKGTNNS VVPYQIHERELNQILKNIVAYL PFMNDEQEDISVVDKIKLIFKF KIPYYVGPLNTKSTRSWVYRSD EKIYPWNFSNVIDLDKTAHEFM NRLIGRCTYTNDPVLPMDSLLY SKYNVLNEINPIKVNGKAIPVE VKQAIYTDLFENSKKKVTRKSI YIYLLKNGYIEKEDIVSGIDIE IKSKLKSHHDFTQIVQENKCTP EEIERIIKGILVYSDDKSMLRR WLKNNIKGLSENDVKYLAKLNY KEWGRLSKTLLTDIYTINPEDG EACSILDIMWNTNATLMEILSN EKYQFKQNIENYKAENYDEKQN LHEELDDMYISPAARRSIWQAL RIVDEIVDIKKSAPKKIFIEMA REKKSAMKKKRTESRKDTLLEL YKSCKSQADGFYDEELFEKLSN ESNSRLRRDQLYLYYTQMGRSM YTGKRIDFDKLINDKNTYDIDH IYPRSKIKDDSITNRVLVEKDI NGEKTDIYPISEDIRQKMQPFW KILKEKGLINEEKYKRLTRNYE LTDEELSSFVARQLVETQQSTK ALATLLKKEYPSAKIVYSKAGN VSEFRNRKDKELPKFREINDLH HAKDAYLNIVVGNVYDTKFTEK FFNNIRNENYSLKRVFDFSVPG AWDAKGSTFNTIKKYMAKNNPI IAFAPYEVKGELFDQQIVPKGK GQFPIKQGKDIEKYGGYNKLSS AFLFAVEYKGKKARERSLETVY IKDVELYLQDPIKYCESVLGLK EPQIIKPKILMGSLFSINNKKL VVTGRSGKQYVCHHIYQLSIND EDSQYLKNIAKYLQEEPDGNIE RQNILNITSVNNIKLFDVLCTK FNSNTYEIILNSLKNDVNEGRE KFSELDILEQCNILLQLLKAFK CNRESSNLEKLNNKKQAGVIVI PHLFTKCSVFKVIHQSITGLFE KEMDLLK (SEQ ID NO: 31) | 179 | 314 | 136 | 544 | 619 | 77 | 544 | 619 | 77 |

TABLE 100-continued

Amino Acid Sequence of Cas9 Orthologs

| Species/Composite ID | Amino acid sequence | REC2 start (AA pos) | REC2 stop (AA pos) | REC2 # AA deleted (n) | REC1$_{CT}$ start (AA pos) | REC1$_{CT}$ stop (AA pos) | REC1$_{CT}$ # AA deleted (n) | Rec$_{sub}$ start (AA pos) | Rec$_{sub}$ stop (AA pos) | Rec$_{sub}$ # AA deleted (n) |
|---|---|---|---|---|---|---|---|---|---|---|
| *Staphylococcus pseudintermedius* ED99 gi\|323463801\| gb\|ADX75954.1\| | MGRKPYILSLDIGTGSVGYACM DKGFNVLKYHDKDALGVYLFDG ALTAQERRQFRTSRRRKNRRIK RLGLLQELLAPLVQNPNFYQFQ RQFAWKNDNMDFKNKSLSEVLS FLGYESKKYPTIYHLQEALLLK DEKFDPELIYMALYHLVKYRGH FLFDHLKIENLTNNDNMHDFVE LIETYENLNNIKLNLDYEKTKV IYEILKDNEMTKNDRAKRVKNM EKKLEQFSIMLLGLKFNEGKLF NHADNAEELKGANQSHTFADNY EENLTPFLTVEQSEFIERANKI YLSLTLQDILKGKKSMAMSKVA AYDKERNELKQVKDIVYKADST RTQFKKIFVSSKKSLKQYDATP NDQTFSSLCLFDQYLIRPKKQY SLLIKELKKIIPQDSELYFEAE NDTLLKVLNTTDNASIPMQINL YEAETILRNQQKYHAEITDEMI EKVLSLIQFRIPYYVGPLVNDH TASKFGWMERKSNESIKPWNED EVVDRSKSATQFIRRMTNKCSY LINEDVLPKNSLLYQEMEVLNE LNATQIRLQTDPKNRKYRMMPQ IKLFAVEHIFKKYKTVSHSKFL EIMLNSNHRENFMNHGEKLSIF GTQDDKKFASKLSSYQDMTKIF GDIEGKRAQIEEIIQWITIFED KKILVQKLKECYPELTSKQINQ LKKLNYSGWGRLSEKLLTHAYQ GHSIIELLRHSDENFMEILTND VYGFQNFIKEENQVQSNKIQHQ DIANLTTSPALKKGIWSTIKLV RELTSIFGEPEKIIMEFATEDQ QKGKKQKSRKQLWDDNIKKNKL KSVDEYKYIIDVANKLNNEQLQ QEKLWLYLSQNGKCMYSGQSID LDALLSPNATKHYEVDHIFPRS FIKDDSIDNKVLVIKKMNQTKG DQVPLQFIQQPYERIAYWKSLN KAGLISDSKLHKLMKPEFTAMD KEGFIQRQLVETRQISVHVRDF LKEEYPNTKVIPMKAKMVSEFR KKFDIPKIRQMNDAHHAIDAYL NGVVYHGAQLAYPNVDLFDFNF KWEKVREKWKALGEFNTKQKSR ELFFFFKKLEKMEVSQGERLISK IKLDMNHFKINYSRKLANIPQQ FYNQTAVSPKTAELKYESNKSN EVVYKGLTPYQTYVVAIKSVNK KGKEKMEYQMIDHYVFDFYKFQ NGNEKELALYLAQRENKDEVLD AQIVYSLNKGDLLYINNHPCYF VSRKEVINAKQFELTVEQQLSL YNVMNNKETNVEKLLIEYDFIA EKVINEYHHYLNSKLKEKRVRT FFSESNQTHEDFIKALDELFKV VTASATRSDKIGSRKNSMTHRA FLGKGKDVKIAYTSISGLKTTK PKSLFKLAESRNEL (SEQ ID NO: 32) | 164 | 299 | 136 | 531 | 606 | 92 | 531 | 606 | 92 |
| *Flavobacterium branchiophilum* FL-15 gi\|347536497\| ref\| YP_004843922.1 | MAKILGLDLGTNSIGWAVVERE NIDFSLIDKGVRIFSEGVKSEK GIESSRAAERTGYRSARKIKYR RKLRKYETLKVLSLNRMCPLSI EEVEEWKKSGFKDYPLNPEFLK WLSTDEESNVNPYFFRDRASKH KVSLFELGRAFYHIAQRRGFLS NRLDQSAEGILEEHCPKIEAIV EDLISIDEISTNITDYFFETGI | 162 | 286 | 125 | 538 | 613 | 63 | 538 | 613 | 63 |

TABLE 100-continued

Amino Acid Sequence of Cas9 Orthologs

| Species/<br>Composite<br>ID | Amino acid sequence | REC2 | | | REC1$_{CT}$ | | | Rec$_{sub}$ | | |
|---|---|---|---|---|---|---|---|---|---|---|
| | | start<br>(AA<br>pos) | stop<br>(AA<br>pos) | # AA<br>deleted<br>(n) | start<br>(AA<br>pos) | stop<br>(AA<br>pos) | # AA<br>deleted<br>(n) | start<br>(AA<br>pos) | stop<br>(AA<br>pos) | # AA<br>deleted<br>(n) |
| | LDSNEKNGYAKDLDEGDKKLVS<br>LYKSLLAILKKNESDFENCKSE<br>IIERLNKKDVLGKVKGKIKDIS<br>QAMLDGNYKTLGQYFYSLYSKE<br>KIRNQYTSREEHYLSEFITICK<br>VQGIDQINEEEKINEKKFDGLA<br>KDLYKAIFFQRPLKSQKGLIGK<br>CSFEKSKSRCAISHPDFEEYRM<br>WTYLNTIKIGTQSDKKLRFLTQ<br>DEKLKLVPKFYRKNDFNFDVLA<br>KELIEKGSSFGFYKSSKKNDFF<br>YWFNYKPTDTVAACQVAASLKN<br>AIGEDWKTKSFKYQTINSNKEQ<br>VSRTVDYKDLWHLLTVATSDVY<br>LYEFAIDKLGLDEKNAKAFSKT<br>KLKKDFASLSLSAINKILPYLK<br>EGLLYSHAVEVANIENIVDENI<br>WKDEKQRDYIKTQISEIIENYT<br>LEKSRFEIINGLLKEYKSENED<br>GKRVYYSKEAEQSFENDLKKKL<br>VLFYKSNEIENKEQQETIFNEL<br>LPIFIQQLKDYEFIKIQRLDQK<br>VLIFLKGKNETGQIFCTEEKGT<br>AEEKEKKIKNRLKKLYHPSDIE<br>KFKKKIIKDEFGNEKIVLGSPL<br>TPSIKNPMAMRALHQLRKVLNA<br>LILEGQIDEKTIIHIEMARELN<br>DANKRKGIQDYQNDNKKFREDA<br>IKEIKKLYFEDCKKEVEPTEDD<br>ILRYQLWMEQNRSEIYEEGKNI<br>SICDIIGSNPAYDIEHTIPRSR<br>SQDNSQMNKTLCSQRFNREVKK<br>QSMPIELNNHLEILPRIAHWKE<br>EADNLTREIEIISRSIKAAATK<br>EIKDKKIRRRHYLTLKRDYLQG<br>KYDRFIWEEPKVGFKNSQIPDT<br>GIITKYAQAYLKSYFKKVESVK<br>GGMVAEFRKIWGIQESFIDENG<br>MKHYKVKDRSKHTHHTIDAITI<br>ACMTKEKYDVLAHAWTLEDQQN<br>KKEARSIIEASKPWKTFKEDLL<br>KIEEEILVSHYTPDNVKKQAKK<br>IVRVRGKKQFVAEVERDVNGKA<br>VPKKAASGKTIYKLDGEGKKLP<br>RLQQGDTIRGSLHQDSIYGAIK<br>NPLNTDEIKYVIRKDLESIKGS<br>DVESIVDEVVKEKIKEAIANKV<br>LLLSSNAQQKNKLVGTVWMNEE<br>KRIAINKVRIYANSVKNPLHIK<br>EHSLLSKSKHVHKQKVYGQNDE<br>NYAMAIYELDGKRDFELINIFN<br>LAKLIKQGQGFYPLHKKKEIKG<br>KIVFVPIEKRNKRDVVLKRGQQ<br>VVFYDKEVENPKDISEIVDFKG<br>RIYIIEGLSIQRIVRPSGKVDE<br>YGVIMLRYFKEARKADDIKQDN<br>FKPDGVFKLGENKPTRKMNHQF<br>TAFVEGIDFKVLPSGKFEKI<br>(SEQ ID NO: 33) | | | | | | | | | |
| Ignavibacterium<br>album<br>JCM 16511<br>gi\|385811609\|<br>ref\|<br>YP_005848005.1 | MEFKKVLGLDIGTNSIGCALLS<br>LPKSIQDYGKGGRLEWLTSRVI<br>PLDADYMKAFIDGKNGLPQVIT<br>PAGKRRQKRGSRRLKHRYKLRR<br>SRLIRVFKTLNWLPEDFPLDNP<br>KRIKETISTEGKFSFRISDYVP<br>ISDESYREFYREFGYPENEIEQ<br>VIEEEINFRRKTKGKNKNPMIKL<br>LPEDWVVYYLRKKALIKPTTKE<br>ELIRIIYLFNQRRGFKSSRKDL<br>TETAILDYDEFAKRLAEKEKYS<br>AENYETKFVSITKVKEVVELKT | 223 | 329 | 107 | 357 | 432 | 90 | 357 | 432 | 90 |

TABLE 100-continued

Amino Acid Sequence of Cas9 Orthologs

| Species/ Composite ID | Amino acid sequence | REC2 start (AA pos) | REC2 stop (AA pos) | REC2 # AA deleted (n) | REC1$_{CT}$ start (AA pos) | REC1$_{CT}$ stop (AA pos) | REC1$_{CT}$ # AA deleted (n) | Rec$_{sub}$ start (AA pos) | Rec$_{sub}$ stop (AA pos) | Rec$_{sub}$ # AA deleted (n) |
|---|---|---|---|---|---|---|---|---|---|---|
| | DGRKGKKRFKVILEDSRIEPYE IERKEKPDWEGKEYTFLVTQKL EKGKFKQNKPDLPKEEDWALCT TALDNRMGSKHPGEFFFDELLK APFKEKRGYKIRQYPVNRWRYKK ELEFIWTKQCQLNPELNNLNIN KEILRKLATVLYPSQSKFFGPK IKEFENSDVLHIISEDIIYYQR DLKSQKSLISECRYEKRKGIDG EIYGLKCIPKSSPLYQEFRIWQ DIHNIKVIRKESEVNGKKKINI DETQLYINENIKEKLFELFNSK DSLSEKDILELISLNIINSGIK ISKKEEETTHRINLFANRKELK GNETKSRYRKVFKKLGFDGEYI LNHPSKLNRLWHSDYSNDYADK EKTEKSILSSLGWKNRNGKWEK SKNYDVFNLPLEVAKAIANLPP LKKEYGSYSALAIRKMLVVMRD GKYWQHPDQIAKDQENTSLMLF DKNLIQLTNNQRKVLNKYLLTL AEVQKRSTLIKQKLNEIEHNPY KLELVSDQDLEKQVLKSFLEKK NESDYLKGLKTYQAGYLIYGKH SEKDVPIVNSPDELGEYIRKKL PNNSLRNPIVEQVIRETIFIVR DVWKSFGIIDEIHIELGRELKN NSEERKKTSESQEKNFQEKERA RKLLKELLNSSNFEHYDENGNK IFSSFTVNPNPDSPLDIEKFRI WKNQSGLTDEELNKKLKDEKIP TEIEVKKYILWLTQKCRSPYTG KIIPLSKLFDSNVYEIEHIIPR SKMKNDSTNNLVICELGVNKAK GDRLAANFISESNGKCKFGEVE YTLLKYGDYLQYCKDTFKYQKA KYKNLLATEPPEDFIERQINDT RYIGRKLAELLTPVVKDSKNII FTIGSITSELKITWGLNGVWKD ILRPRFKRLESIINKKLIFQDE DDPNKYHFDLSINPQLDKEGLK RLDHRHHALDATIIAATTREHV RYLNSLNAADNDEEKREYFLSL CNHKIRDFKLPWENFTSEVKSK LLSCVVSYKESKPILSDPFNKY LKWEYKNGKWQKVFAIQIKNDR WKAVRRSMFKEPIGTVWIKKIK EVSLKEAIKIQAIWEEVKNDPV RKKKEKYIYDDYAQKVIAKIVQ ELGLSSSMRKQDDEKLNKFINE AKVSAGVNKNLNTTNKTIYNLE GRFYEKIKVAEYVLYKAKRMPL NKKEYIEKLSLQKMFNDLPNFI LEKSILDNYPEILKELESDNKY IIEPHKKNNPVNRLLLEHILEY HNNPKEAFSTEGLEKLNKKAIN KIGKPIKYITRLDGDINEEEIF RGAVFETDKGSNVYFVMYENNQ TKDREFLKPNPSISVLKAIEHK NKIDFFAPNRLGFSRIILSPGD LVYVPTNDQYVLIKDNSSNETI INWDDNEFISNRIYQVKKFTGN SCYFLKNDIASLILSYSASNGV GEFGSQNISEYSVDDPPIRIKD VCIKIRVDRLGNVRPL (SEQ ID NO: 34) | | | | | | | | | | |

TABLE 100-continued

Amino Acid Sequence of Cas9 Orthologs

| Species/ Composite ID | Amino acid sequence | REC2 | | | REC1$_{CT}$ | | | Rec$_{sub}$ | | |
|---|---|---|---|---|---|---|---|---|---|---|
| | | start (AA pos) | stop (AA pos) | # AA deleted (n) | start (AA pos) | stop (AA pos) | # AA deleted (n) | start (AA pos) | stop (AA pos) | # AA deleted (n) |
| Bergeyella zoohelcum ATCC 43767 gi\|423317190\|ref\| ZP_17295095.1 | MKHILGLDLGTNSIGWALIERN IEEKYGKIIGMGSRIVPMGAEL SKFEQGQAQTKNADRRTNRGAR RLNKRYKQRRNKLIYILQKLDM LPSQIKLKEDFSDPNKIDKITI LPISKKQEQLTAFDLVSLRVKA LTEKVGLEDLGKIIYKYNQLRG YAGGSLEPEKEDIFDEEQSKDK KNKSFIAFSKIVFLGEPQEEIF KNKKLNRRAIIVETEEGNFEGS TFLENIKVGDSLELLINISASK SGDTITIKLPNKTNWRKKMENI ENQLKEKSKEMGREFYISEFLL ELLKENRWAKIRNNTILRARYE SEFEAIWNEQVKHYPFLENLDK KTLIEIVSFIFPGEKESQKKYR ELGLEKGLKYIIKNQVVFYQRE LKDQSHLISDCRYEPNEKAIAK SHPVFQEYKVWEQINKLIVNTK IEAGTNRKGEKKYKYIDRPIPT ALKEWIFEELQNKKEITFSAIF KKLKAEFDLREGIDFLNGMSPK DKLKGNETKLQLQKSLGELWDV LGLDSINRQIELWNILYNEKGN EYDLTSDRTSKVLEFINKYGNN IVDDNAEETAIRISKIKFARAY SSLSLKAVERILPLVRAGKYFN NDFSQQLQSKILKLLNENVEDP FAKAAQTYLDNNQSVLSEGGVG NSIATILVYDKHTAKEYSHDEL YKSYKEINLLKQGDLRNPLVEQ IINEALVLIRDIWKNYGIKPNE IRVELARDLKNSAKERATIHKR NKDNQTINNKIKETLVKNKKEL SLANIEKVKLWEAQRHLSPYTG QPIPLSDLFDKEKYDVDHIIPI SRYFDDSFTNKVISEKSVNQEK ANRTAMEYFEVGSLKYSIFTKE QFIAHVNEYFSGVKRKNLLATS IPEDPVQRQIKDTQYIAIRVKE ELNKIVGNENVKTTTGSITDYL RNHWGLTDKFKLLLKERYEALL ESEKFLEAEYDNYKKDFDSRKK EYEEKEVLFEEQELTREEFIKE YKENYIRYKKNKLIIKGWSKRI DHRHHAIDALIVACTEPAHIKR LNDLNKVLQDWLVEHKSEFMPN FEGSNSELLEEILSLPENERTE IFTQIEKFRAIEMPWKGFPEQV EQKLKEIIISHKPKDKLLLQYN KAGDRQIKLRGQLHEGTLYGIS QGKEAYRIPLTKFGGSKFATEK NIQKIVSPFLSGFIANHLKEYN NKKEEAFSAEGIMDLNNKLAQY RNEKGELKPHTPISTVKIYYKD PSKNKKKKDEEDLSLQKLDREK AFNEKLYVKTGDNYLFAVLEGE IKTKKTSQIKRLYDIISFFDAT NFLKEEFRNAPDKKTFDKDLLF RQYFEERNKAKLLFTLKQGDFV YLPNENEEVILDKESPLYNQYW GDLKERGKNIYVVQKFSKKQIY FIKHTIADIIKKDVEFGSQNCY ETVEGRSIKENCFKLEIDRLGN IVKVIKR (SEQ ID NO: 35) | 165 | 261 | 97 | 529 | 604 | 56 | 529 | 604 | 56 |
| Nitrobacter hamburgensis X14 gi\|92109262\|ref\| | MHVEIDFPHFSRGDSHLAMNKN EILRGSSVLYRLGLDLGSNSLG WFVTHLEKRGDRHEPVALGPGG VRIFPDGRDPQSGTSNAVDRRM ARGARKRRDRFVERRKELIAAL | 169 | 253 | 85 | 536 | 611 | 48 | 536 | 611 | 48 |

TABLE 100-continued

Amino Acid Sequence of Cas9 Orthologs

| Species/ Composite ID | Amino acid sequence | REC2 start (AA pos) | REC2 stop (AA pos) | REC2 # AA deleted (n) | REC1$_{CT}$ start (AA pos) | REC1$_{CT}$ stop (AA pos) | REC1$_{CT}$ # AA deleted (n) | Rec$_{sub}$ start (AA pos) | Rec$_{sub}$ stop (AA pos) | Rec$_{sub}$ # AA deleted (n) |
|---|---|---|---|---|---|---|---|---|---|---|
| YP_571550.1| | IKYNLLPDDARERRALEVLDPY ALRKTALTDTLPAHHVGRALFH LNQRRGFQSNRKTDSKQSEDGA IKQAASRLATDKGNETLGVFFA DMHLRKSYEDRQTAIRAELVRL GKDHLTGNARKKIWAKVRKRLF GDEVLPRADAPHGVRARATITG TKASYDYYPTRDMLRDEFNAIW AGQSAHHATITDEARTEIEHII FYQRPLKPAIVGKCTLDPATRP FKEDPEGYRAPWSHPLAQRFRI LSEARNLEIRDTGKGSRRLTKE QSDLVVAALLANREVKFDKLRT LLKLPAEARFNLESDRRAALDG DQTAARLSDKKGFNKAWRGFPP ERQIAIVARLEETEDENELIAW LEKECALDGAAAARVANTTLPD GHCRLGLRAIKKIVPIMQDGLD EDGVAGAGYHIAAKRAGYDHAK LPTGEQLGRLPYYGQWLQDAVV GSGDARDQKEKQYGQFPNPTVH IGLGQLRRVVNDLIDKYGPPTE ISIEFTRALKLSEQQKAERQRE QRRNQDKNKARAEELAKFGRPA NPRNLLKMRLWEELAHDPLDRK CVYTGEQISIERLLSDEVDIDH ILPVAMTLDDSPANKIICMRYA NRHKRKQTPSEAFGSSPTLQGH RYNWDDIAARATGLPRNKRWRF DANAREEFDKRGGFLARQLNET GWLARLAKQYLGAVTDPNQIWV VPGRLTSMLRGKWGLNGLLPSD NYAGVQDKAEEFLASTDDMEFS GVKNRADHRHHAIDGLVTALTD RSLLWKMANAYDEEHEKFVIEP PWPTMRDDLKAALEKMVVSHKP DHGIEGKLHEDSAYGFVKPLDA TGLKEEEAGNLVYRKAIESLNE NEVDRIRDIQLRTIVRDHVNVE KTKGVALADALRQLQAPSDDYP QFKHGLRHVRILKKEKGDYLVP IANRASGVAYKAYSAGENFCVE VFETAGGKWDGEAVRRFDANKK NAGPKIAHAPQWRDANEGAKLV MRIHKGDLIRLDHEGRARIMVV HRLDAAAGRFKLADHNETGNLD KRHATNNDIDPFRWLMASYNTL KKLAAVPVRVDELGRVWRVMPN (SEQ ID NO: 36) | | | | | | | | | | |
| *Odoribacter laneus* YIT 12061 gi|374384763| ref| ZP_09642280.1 | METTLGIDLGTNSIGLALVDQE EHQILYSGVRIFPEGINKDTIG LGEKEESRNATRRAKRQMRRQY FRKKLRKAKLLELLIAYDMCPL KPEDVRRWKNWDKQQKSTVRQF PDTPAFREWLKQNPYELRKQAV TEDVTRPELGRILYQMIQRRGF LSSRKGKEEGKIFTGKDRMVGI DETRKNLQKQTLGAYLYDIAPK NGEKYRFRTERVRARYTLRDMY IREFEIIWQRQAGHLGLAHEQA TRKKNIFLEGSATNVRNSKLIT HLQAKYGRGHVLIEDTRITVTF QLPLKEVLGGKIEIEEEQLKFK SNESVLFWQRPLRSQKSLLSKC VFEGRNFYDPVHQKWIIAGPTP APLSHPEFEEFRAYQFINNIIY GKNEHLTAIQREAVFELMCTES KDFNFEKIPKHLKLFEKFNFDD TTKVPACTTISQLRKLFPHPVW EEKREEIWHCFYFYDDNTLLFE KLQKDYALQTNDLEKIKKIRLS | 164 | 242 | 79 | 535 | 610 | 63 | 535 | 610 | 63 |

TABLE 100-continued

Amino Acid Sequence of Cas9 Orthologs

| Species/ Composite ID | Amino acid sequence | REC2 | | | REC1$_{CT}$ | | | Rec$_{sub}$ | | |
|---|---|---|---|---|---|---|---|---|---|---|
| | | start (AA pos) | stop (AA pos) | # AA deleted (n) | start (AA pos) | stop (AA pos) | # AA deleted (n) | start (AA pos) | stop (AA pos) | # AA deleted (n) |
| | ESYGNVSLKAIRRINPYLKKGY AYSTAVLLGGIRNSFGKRFEYF KEYEPEIEKAVCRILKEKNAEG EVIRKIKDYLVHNRFGFAKNDR AFQKLYHHSQAITTQAQKERLP ETGNLRNPIVQQGLNELRRTVN KLLATCREKYGPSFKFDHIHVE MGRELRSSKTEREKQSRQIREN EKKNEAAKVKLAEYGLKAYRDN IQKYLLYKEIEEKGGTVCCPYT GKTLNISHTLGSDNSVQIEHII PYSISLDDSLANKTLCDATFNR EKGELTPYDFYQKDPSPEKWGA SSWEEIEDRAFRLLPYAKAQRF IRRKPQESNEFISRQLNDTRYI SKKAVEYLSAICSDVKAFPGQL TAELRHLWGLNNILQSAPDITF PLPVSATENHREYYVITNEQNE VIRLFPKQGETPRTEKGELLLT GEVERKVFRCKGMQEFQTDVSD GKYWRRIKLSSSVTWSPLFAPK PISADGQIVLKGRIEKGVFVCN QLKQKLKTGLPDGSYWISLPVI SQTFKEGESVNNSKLTSQQVQL FGRVREGIFRCHNYQCPASGAD GNFWCTLDTDTAQPAFTPIKNA PPGVGGGQIILTGDVDDKGIFH ADDDLHYELPASLPKGKYYGIF TVESCDPTLIPIELSAPKTSKG ENLIEGNIWVDEHTGEVREDPK KNREDQRHHAIDAIVIALSSQS LFQRLSTYNARRENKKRGLDST EHFPSPWPGFAQDVRQSVVPLL VSYKQNPKTLCKISKTLYKDGK KIHSCGNAVRGQLHKETVYGQR TAPGATEKSYHIRKDIRELKTS KHIGKVVDITIRQMLKHLQEN YHIDITQEFNIPSNAFFKEGVY RIFLPNKHGEPVPIKKIRMKEE LGNAERLKDNINQYVNPRNNHH VMIYQDADGNLKEEIVSFWSVI ERQNQGQPIYQLPREGRNIVSI LQINDTFLIGLKEEEPEVYRND LSTLSKHLYRVQKLSGMYYTFR HHLASTLNNEREEFRIQSLEAW KRANPVKVQIDEIGRITFLNGP LC (SEQ ID NO: 37) | | | | | | | | | |
| Legionella pneumophila str. Paris gi\|54296138\| ref\| YP_122507.1\| | MESSQILSPIGIDLGGKFTGVC LSHLEAFAELPNHANTKYSVIL IDHNNFQLSQAQRRATRHRVRN KKRNQFVKRVALQLFQHILSRD LNAKEETALCHYLNNRGYTYVD TDLDEYIKDETTINLLKELLPS ESEHNFIDWFLQKMQSSEFRKI LVSKVEEKKDDKELKNAVKNIK NFITGFEKNSVEGHRHRKVYFE NIKSDITKDNQLDSIKKKIPSV CLSNLLGHLSNLQWKNLHRYLA KNPKQFDEQTFGNEFLRMLKNF RHLKGSQESLAVRNLIQQLEQS QDYISILEKTPPEITIPPYEAR TNTGMEKDQSLLLNPEKLNNLY PNWRNLIPGIIDAHPFLEKDLE HTKLRDRKRIISPSKQDEKRDS YILQRYLDLNKKIDKFKIKKQL SFLGQGKQLPANLIETQKEMET HFNSSLVSVLIQIASAYNKERE DAAQGIWFDNAFSLCELSNINP PRKQKILPLLVGAILSEDFINN KDKWAKFKIFWNTHKIGRTSLK SKCKEIEEARKNSGNAFKIDYE | 164 | 239 | 76 | 402 | 476 | 67 | 402 | 476 | 67 |

TABLE 100-continued

Amino Acid Sequence of Cas9 Orthologs

| Species/ Composite ID | Amino acid sequence | REC2 start (AA pos) | REC2 stop (AA pos) | REC2 # AA deleted (n) | REC1$_{CT}$ start (AA pos) | REC1$_{CT}$ stop (AA pos) | REC1$_{CT}$ # AA deleted (n) | Rec$_{sub}$ start (AA pos) | Rec$_{sub}$ stop (AA pos) | Rec$_{sub}$ # AA deleted (n) |
|---|---|---|---|---|---|---|---|---|---|---|
| | EALNHPEHSNNKALIKIIQTIP DIIQAIQSHLGHNDSQALIYHN PFSLSQLYTILETKRDGFHKNC VAVTCENYWRSQKTEIDPEISY ASRLPADSVRPFDGVLARMMQR LAYEIAMAKWEQIKHIPDNSSL LIPIYLEQNRFEFEESFKKIKG SSSDKTLEQAIEKQNIQWEEKF QRIINASMNICPYKGASIGGQG EIDHIYPRSLSKKHFGVIFNSE VNLIYCSSQGNREKKEEHYLLE HLSPLYLKHQFGTDNVSDIKNF ISQNVANIKKYISFHLLTPEQQ KAARHALFLDYDDEAFKTITKF LMSQQKARVNGTQKFLGKQIME FLSTLADSKQLQLEFSIKQITA EEVHDHRELLSKQEPKLVKSRQ QSFPSHAIDATLTMSIGLKEFP QFSQELDNSWFINHLMPDEVHL NPVRSKEKYNKPNISSTPLFKD SLYAERFIPVWVKGETFAIGFS EKDLFEIKPSNKEKLFTLLKTY STKNPGESLQELQAKSKAKWLY FPINKTLALEFLHHYFHKEIVT PDDTTVCHFINSLRYYTKKESI TVKILKEPMPVLSVKFESSKKN VLGSFKHTIALPATKDWERLFN HPNFLALKANPAPNPKEFNEFI RKYFLSDNNPNSDIPNNGHNIK PQKHKAVRKVFSLPVIPGNAGT MMRIRRKDNKGQPLYQLQTIDD TPSMGIQINEDRLVKQEVLMDA YKTRNLSTIDGINNSEGQAYAT FDNWLTLPVSTFKPEIIKLEMK PHSKTRRYIRITQSLADFIKTI DEALMIKPSDSIDDPLNMPNEI VCKNKLFGNELKPRDGKMKIVS TGKIVTYEFESDSTPQWIQTLY VTQLKKQP (SEQ ID NO: 38) | | | | | | | | | | |
| Bacteroides sp. 203 gi\|301311869\| ref\| ZP_07217791.1 | MKKIVGLDLGTNSIGWALINAY INKEHLYGIEACGSRIIPMDAA ILGNFDKGNSISQTADRTSYRG IRRLRERHLLRRERLHRILDLL GFLPKHYSDSLNRYGKFLNDIE CKLPWVKDETGSYKFIFQESFK EMLANFTEHHPILIANNKKVPY DWTIYYLRKKALTQKISKEELA WILLNFNQKRGYYQLRGEEEET PNKLVEYYSLKVEKVEDSGERK GKDTWYNVHLENGMIYRRTSNI PLDWEGKTKEFIVTTDLEADGS PKKDKEGNIKRSFRAPKDDDWT LIKKKTEADIDKIKMTVGAYIY DTLLQKPDQKIRGKLVRTIERK YYKNELYQILKTQSEFHEELRD KQLYIACLNELYPNNEPRRNSI STRDFCHLFIEDIIFYQRPLKS KKSLIDNCPYEENRYIDKESGE IKHASIKCIAKSHPLYQEFRLW QFIVNLRIYRKETDVDVTQELL PTEADYVTLFEWLNEKKEIDQK AFFKYPPFGFKKTTSNYRWNYV EDKPYPCNETHAQIIARLGKAH IPKAFLSKEKEETLWHILYSIE DKQEIEKALHSFANKNNLSEEF IEQFKNFPPPFKKEYGSYSAKAI KKLLPLMRMGKYWSIENIDNGT RIRINKIIDGEYDENIRERVRQ KAINLTDITHFRALPLWLACYL VYDRHSEVKDIVKWKTPKDIDL | 198 | 269 | 72 | 530 | 604 | 83 | 530 | 604 | 83 |

TABLE 100-continued

Amino Acid Sequence of Cas9 Orthologs

| Species/ Composite ID | Amino acid sequence | REC2 start (AA pos) | REC2 stop (AA pos) | REC2 # AA deleted (n) | REC1$_{CT}$ start (AA pos) | REC1$_{CT}$ stop (AA pos) | REC1$_{CT}$ # AA deleted (n) | Rec$_{sub}$ start (AA pos) | Rec$_{sub}$ stop (AA pos) | Rec$_{sub}$ # AA deleted (n) |
|---|---|---|---|---|---|---|---|---|---|---|
| | YLKSFKQHSLRNPIVEQVITET LRTVRDIWQQVGHIDEIHIELG REMKNPADKRARMSQQMIKNEN TNLRIKALLTEFLNPEFGIENV RPYSPSQQDLLRIYEEGVLNSI LELPEDIGIILGKFNQTDTLKR PTRSEILRYKLWLEQKYRSPYT GEMIPLSKLFTPAYEIEHIIPQ SRYFDDSLSNKVICESEINKLK DRSLGYEFIKNHHGEKVELAFD KPVEVLSVEAYEKLVHESYSHN RSKMKKLLMEDIPDQFIERQLN DSRYISKVVKSLLSNIVREENE QEAISKNVIPCTGGITDRLKKD WGINDVWNKIVLPRFIRLNELT ESTRFTSINTNNTMIPSMPLEL QKGFNKKRIDHRHHAMDAIIIA CANRNIVNYLNNVSASKNTKIT RRDLQTLLCHKDKTDNNGNYKW VIDKPWETFTQDTLTALQKITV SPKQNLRVINKTTNHYQHYENG KKIVSNQSKGDSWAIRKSMHKE TVHGEVNLRMIKTVSFNEALKK PQAIVEMDLKKKILAMLELGYD TKRIKNYFEENKDTWQDINPSK IKVYYFTKETKDRYFAVRKPID TSFDKKKIKESITDTGIQQIML RHLETKDNDPTLAFSPDGIDEM NRNILILNGKKHQPIYKVRVY EKAEKFTVGQKGNKRTKFVEAA KGTNLFFAIYETEEIDKDTKKV IRKRSYSTIPLNVVIERQKQGL SSAPEDENGNLPKYILSPNDLV YVPTQEEINKGEVVMPIDRDRI YKMVDSSGITANFIPASTANLI FALPKATAEIYCNGENCIQNEY GIGSPQSKNQKAITGEMVKEIC FPIKVDRLGNIIQVGSCILTN (SEQ ID NO: 39) | | | | | | | | | | |
| *Akkermansia muciniphila* ATCC BAA-835 gi\|187736489\| ref\| YP_001878601. | MSRSLTFSFDIGYASIGWAVIA SASHDDADPSVCGCGTVLFPKD DCQAFKRREYRRLRRNIRSRRV RIERIGRLLVQAQIITPEMKET SGHPAPFYLASEALKGHRTLAP IELWHVLRWYAHNRGYDNNASW SNSLSEDGGNGEDTERVKHAQD LMDKHGTATMAETICRELKLEE GKADAPMEVSTPAYKNLNTAFP RLIVEKEVRRILELSAPLIPGL TAEIIELIAQHHPLTTEQRGVL LQHGIKLARRYRGSLLFGQLIP RFDNRIISRCPVTWAQVYEAEL KKGNSEQSARERAEKLSKVPTA NCPEFYEYRMARILCNIRADGE PLSAEIRRELMNQARQEGKLTK ASLEKAISSRLGKETETNVSNY FTLHPDSEEALYLNPAVEVLQR SGIGQILSPSVYRIAANRLRRG KSVTPNYLLNLLKSRGESGEAL EKKIEKESKKKEADYADTPLKP KYATGRAPYARTVLKKVVEEIL DGEDPTRPARGEAHPDGELKAH DGCLYCLLDTDSSVNQHQKERR LDTMTNNHLVRHRMLILDRLLK DLIQDFADGQKDRISRVCVEVG KELTTFSAMDSKKIQRELTLRQ KSHTDAVNRLKRKLPGKALSAN LIRKCRIAMDMNWTCPFTGATY GDHELENLELEHIVPHSFRQSN ALSSLVLTWPGVNRMKGQRTGY DFVEQEQENPVPDKPNLHICSL | 136 | 202 | 67 | 348 | 418 | 62 | 348 | 418 | 62 |

TABLE 100-continued

Amino Acid Sequence of Cas9 Orthologs

| Species/ Composite ID | Amino acid sequence | REC2 | | | REC1$_{CT}$ | | | Rec$_{sub}$ | | |
|---|---|---|---|---|---|---|---|---|---|---|
| | | start (AA pos) | stop (AA pos) | # AA deleted (n) | start (AA pos) | stop (AA pos) | # AA deleted (n) | start (AA pos) | stop (AA pos) | # AA deleted (n) |
| | NNYRELVEKLDDKKGHEDDRRR KKKRKALLMVRGLSHKHQSQNH EAMKEIGMTEGMMTQSSHLMKL ACKSIKTSLPDAHIDMIPGAVT AEVRKAWDVFGVFKELCPEAAD PDSGKILKENLRSLTHLHHALD ACVLGLIPYIIPAHHNGLLRRV LAMRRIPEKLIPQVRPVANQRH YVLNDDGRMMLRDLSASLKENI REQLMEQRVIQHVPADMGGALL KETMQRVLSVDGSGEDAMVSLS KKKDGKKEKNQVKASKLVGVFP EGPSKLKALKAAIEIDGNYGVA LDPKPVVIRHIKVFKRIMALKE QNGGKPVRILKKGMLIHLTSSK DPKHAGVWRIESIQDSKGGVKL DLQRAHCAVPKNKTHECNWREV DLISLLKKYQMKRYPTSYTGTP R (SEQ ID NO: 40) | | | | | | | | | |
| Prevotella sp. C561 gi\|345885718\| ref\| ZP_08837074.1 | MTQKVLGLDLGTNSIGSAVRNL DLSDDLQWQLEFFSSDIFRSSV NKESNGREYSLAAQRSAHRRSR GLNEVRRRRLWATLNLLIKHGF CPMSSESLMRWCTYDKRKGLFR EYPIDDKDFNAWILLDENGDGR PDYSSPYQLRRELVTRQFDFEQ PIERYKLGRALYHIAQHRGFKS SKGETLSQQETNSKPSSTDEIP DVAGAMKASEEKLSKGLSTYMK EHNLLTVGAAFAQLEDEGVRVR NNNDYRAIRSQFQHEIETIFKF QQGLSVESELYERLISEKKNVG TIFYKRPLRSQRGNVGKCTLER SKPRCAIGHPLFEKFRAWTLIN NIKVRMSVDTLDEQLPMKLRLD LYNECFLAFVRTEFKFEDIRKY LEKRLGIHFSYNDKTINYKDST SVAGCPITARFRKMLGEEWESF RVEGQKERQAHSKNNISFHRVS YSIEDIWHFCYDAEEPEAVLAF AQETLRLERKKAEELVRIWSAM PQGYAMLSQKAIRNINKILMLG LKYSDAVILAKVPELVDVSDEE LLSIAKDYYLVEAQVNYDKRIN SIVIGLIAKYKSVSEEYRFADH NYEYLLDESDEKDIIRQIENSL GARRWSLMDANEQTDILQKVRD RYQDFFRSHERKFVESPKLGES FENYLTKKFPMVEREQWKKLYH PSQITIYRPVSVGKDRSVLRLG NPDIGAIKNPTVLRVLNTLRRR VNQLLDDGVISPDETRVVVETA RELNDANRKWALDTYNRIRHDE NEKIKKILEEFYPKRDGISTDD IDKARYVIDQREVDYFTGSKTY NKDIKKYKFWLEQGGQCMYTGR TINLSNLFDPNAFDIEHTIPES LSFDSSDMNLTLCDAHYNRFIK KNHIPTDMPNYDKAITIDGKEY PAITSQLQRWVERVERLNRNVE YWKGQARRAQNKDRKDQCMREM HLWKMELEYWKKKLERFTVTEV TDGFKNSQLVDTRVITRHAVLY LKSIFPHVDVQRGDVTAKFRKI LGIQSVDEKKDRSLHSHHAIDA TTLTIIPVSAKRDRMLELFAKI EEINKMLSFSGSEDRTGLIQEL EGLKNKLQMEVKVCRIGHNVSE IGTFINDNIIVNHHIKNQALTP VRRRLRKKGYIVGGVDNPRWQT GDALRGEIHKASYYGAITQFAK | 184 | 250 | 67 | 357 | 425 | 78 | 357 | 425 | 78 |

TABLE 100-continued

Amino Acid Sequence of Cas9 Orthologs

| Species/ Composite ID | Amino acid sequence | REC2 | | | REC1$_{CT}$ | | | Rec$_{sub}$ | | |
|---|---|---|---|---|---|---|---|---|---|---|
| | | start (AA pos) | stop (AA pos) | # AA deleted (n) | start (AA pos) | stop (AA pos) | # AA deleted (n) | start (AA pos) | stop (AA pos) | # AA deleted (n) |
| | DDEGKVLMKEGRPQVNPTIKFV IRRELKYKKSAADSGFASWDDL GKAIVDKELFALMKGQFPAETS FKDACEQGIYMIKKGKNGMPDI KLHHIRHVRCEAPQSGLKIKEQ TYKSEKEYKRYFYAAVGDLYAM CCYTNGKIREFRIYSLYDVSCH RKSDIEDIPEFITDKKGNRLML DYKLRTGDMILLYKDNPAELYD LDNVNLSRRLYKINRFESQSNL VLMTHHLSTSKERGRSLGKTVD YQNLPESIRSSVKSLNFLIMGE NRDFVIKNGKIIFNHR (SEQ ID NO: 41) | | | | | | | | | |
| Wolinella succinogenes DSM 1740 gi\|34557932\| ref\| NP_907747.1\| | MLVSPISVDLGGKNTGFFSFTD SLDNSQSGTVIYDESFVLSQVG RRSKRHSKRNNLRNKLVKRLFL LILQEHHGLSIDVLPDEIRGLF NKRGYTYAGFELDEKKKDALES DTLKEFLSEKLQSIDRDSDVED FLNQIASNAESFKDYKKGFEAV FASATHSPNKKLELKDELKSEY GENAKELLAGLRVTKEILDEFD KQENQGNLPRAKYFEELGEYIA TNEKVKSFFDSNSLKLTDMTKL IGNISNYQLKELRRYFNDKEME KGDIWIPNKLHKITERFVRSWH PKNDADRQRRAELMKDLSKEI MELLTTTEPVMTIPPYDDMNNR GAVKCQTLRLNEEYLDKHLPNW RDIAKRLNHGKENDDLADSTVK GYSEDSTLLHRLLDTSKEIDIY ELRGKKPNELLVKTLGQSDANR LYGFAQNYYELIRQKVRAGIWV PVKNKDDSLNLEDNSNMLKRCN HNPPHKKNQIHNLVAGILGVKL DEAKFAEFEKELWSAKVGNKKL SAYCKNIEELRKTHGNTFKIDI EELRKKDPAELSKEEKAKLRLT DDVILNEWSQKIANFFDIDDKH RQRFNNLFSMAQLHTVIDTPRS GFSSTCKRCTAENRFRSETAFY NDETGEFHKKATATCQRLPADT QRPFSGKIERYIDKLGYELAKI KAKELEGMEAKEIKVPIILEQN AFEYEESLRKSKTGSNDRVINS KKDRDGKKLAKAKENAEDRLKD KDKRIKAFSSGICPYCGDTIGD DGEIDHILPRSHTLKIYGTVEN PEGNLIYVHQKCNQAKADSIYK LSDIKAGVSAQWIEEQVANIKG YKTFSVLSAEQQKAFRYALFLQ NDNEAYKKVVDWLRTDQSARVN GTQKYLAKKIQEKLTKMLPNKH LSFEFILADATEVSELRRQYAR QNPLLAKAEKQAPSSHAIDAVM AFVARYQKVFKDGTPPNADEVA KLAMLDSWNPASNEPLTKGLST NQKIEKMIKSGDYGQKNMREVF GKSIFGENAIGERYKPIVVQEG GYYIGYPATVKKGYELKNCKVV TSKNDIAKLEKIIKNQDLISLK ENQYIKIFSINKQTISELSNRY FNMNYKNLVERDKEIVGLLEFI VENCRYYTKKVDVKFAPKYIHE TKYPFYDDWRRFDEAWRYLQEN QNKTSSKDRFVIDKSSLNEYYQ PDKNEYKLDVDTQPIWDDFCRW YFLDRYKTANDKKSIRIKARKT FSLLAESGVQGKVFRAKRKIPT GYAYQALPMDNNVIAGDYANIL | 157 | 218 | 36 | 401 | 468 | 60 | 401 | 468 | 60 |

TABLE 100-continued

Amino Acid Sequence of Cas9 Orthologs

| Species/ Composite ID | Amino acid sequence | REC2 start (AA pos) | REC2 stop (AA pos) | REC2 # AA deleted (n) | REC1_CT start (AA pos) | REC1_CT stop (AA pos) | REC1_CT # AA deleted (n) | Rec_sub start (AA pos) | Rec_sub stop (AA pos) | Rec_sub # AA deleted (n) |
|---|---|---|---|---|---|---|---|---|---|---|
| | LEANSKTLSLVPKSGISIEKQL DKKLDVIKKTDVRGLAIDNNSF FNADFDTHGIRLIVENTSVKVG NFPISAIDKSAKRMIFRALFEK EKGKRKKKTTISFKESGPVQDY LKVFLKKIVKIQLRTDGSISNI VVRKNAADFTLSFRSEHIQKLL K (SEQ ID NO: 42) | | | | | | | | | |
| Alicyclobacillus hesperidum URH17-3-68 gi\|403744858\| ref\| ZP_10953934.1 | MAYRLGLDIGITSVGWAVVALE KDESGLKPVRIQDLGVRIFDKA EDSKTGASLALPRREARSARRR TRRRRHRLWRVKRLLEQHGILS MEQIEALYAQRTSSPDVYALRV AGLDRCLIAEEIARVLIHIAHR RGFQSNRKSEIKDSDAGKLLKA VQENENLMQSKGYRTVAEMLVS EATKTDAEGKLVHGKKHGYVSN VRNKAGEYRHTVSRQAIVDEVR KIFAAQRALGNDVMSEELEDSY LKILCSQRNFDDGPGGDSPYGH GSVSPDGVRQSIYERMVGSCTF ETGEKRAPRSSYSFERFQLLTK VVNLRIYRQQEDGGRYPCELTQ TERARVIDCAYEQTKITYGKLR KLLDMKDTESFAGLTYGLNRSR NKTEDTVFVEMKFYHEVRKALQ RAGVFIQDLSIETLDQIGWILS VWKSDDNRRKKLSTLGLSDNVI EELLPLNGSKFGHLSLKAIRKI LPFLEDGYSYDVACELAGYQFQ GKTEYVKQRLLPPLGEGEVTNP VVRRALSQAIKVVNAVIRKHGS PESIHIELARELSKNLDERRKI EKAQKENQKNNEQIKDEIREIL GSAHVTGRDIVKYKLFKQQQEF CMYSGEKLDVTRLFEPGYAEVD HIIPYGISFDDSYDNKVLVKTE QNRQKGNRTPLEYLRDKPEQKA KFIALVESIPLSQKKKNHLLMD KRAIDLEQEGFRERNLSDTRYI TRALMNHIQAWLLFDETASTRS KRVVCVNGAVTAYMRARWGLTK DRDAGDKHHAADAVVVACIGDS LIQRVTKYDKFKRNALADRNRY VQQVSKSEGITQYVDKETGEVF TWESFDERKFLPNEPLEPWPFF RDELLARLSDDPSKNIRAIGLL TYSETEQIDPIFVSRMPTRKVT GAAHKETIRSPRIVKVDDNKGT EIQVVVSKVALTELKLTKDGEI KDYFRPEDDPRLYNTLRERLVQ FGGDAKAAFKEPVYKISKDGSV RTPVRKVKIQEKLTLGVPVHGG RGIAENGGMVRIDVFAKGGKYY FVPIYVADVLKRELPNRLATAH KPYSEWRVVDDSYQFKFSLYPN DAVMIKPSREVDITYKDRKEPV GCRIMYFVSANIASASISLRTH DNSGELEGLGIQGLEVFEKYVV GPLGDTHPVYKERRMPFRVERK MN (SEQ ID NO: 43) | 142 | 196 | 55 | 416 | 482 | 61 | 416 | 482 | 61 |
| Caenispirillum salinarum AK4 gi\|427429481\| ref\| ZP_18919511.1 | MPVLSPLSPNAAQGRRRWSLAL DIGEGSIGWAVAEVDAEGRVLQ LTGTGVTLFPSAWSNENGTYVA HGAADRAVRGQQQRHDSRRRL AGLARLCAPVLERSPEDLKDLT RTPPKADPRAIFFLRADAARRP LDGPELFRVHHMAAHRGIRLA ELQEVDPPPESDADDAAPAATE DEDGTRRAAADERAFRRLMAEH | 161 | 214 | 54 | 330 | 393 | 68 | 330 | 393 | 68 |

TABLE 100-continued

Amino Acid Sequence of Cas9 Orthologs

| | | REC2 | | | REC1$_{CT}$ | | | Rec$_{sub}$ | | |
|---|---|---|---|---|---|---|---|---|---|---|
| Species/ Composite ID | Amino acid sequence | start (AA pos) | stop (AA pos) | # AA deleted (n) | start (AA pos) | stop (AA pos) | # AA deleted (n) | start (AA pos) | stop (AA pos) | # AA deleted (n) |
| | MHRHGTQPTCGEIMAGRLRETP AGAQPVTRARDGLRVGGGVAVP TRALIEQEFDAIRAIQAPRHPD LPWDSLRRLVLDQAPIAVPPAT PCLFLEELRRRGETFQGRTITR EAIDRGLTVDPLIQALRIRETV GNLRLHERITEPDGRQRYVPRA MPELGLSHGELTAPERDTLVRA LMHDPDGLAAKDGRIPYTRLRK LIGYDNSPVCFAQERDTSGGGI TVNPTDPLMARWIDGWVDLPLK ARSLYVRDVVARGADSAALARL LAEGAHGVPPVAAAAVPAATAA ILESDIMQPGRYSVCPWAAEAI LDAWANAPTEGFYDVTRGLFGF APGEIVLEDLRRARGALLAHLP RTMAAARTPNRAAQQRGPLPAY ESVIPSQLITSLRRAHKGRAAD WSAADPEERNPFLRTWTGNAAT DHILNQVRKTANEVITKYGNRR GWDPLPSRITVELAREAKHGVI RRNEIAKENENEGRRKKESAA LDTFCQDNTVSWQAGGLPKERA ALRLRLAQRQEFFCPYCAERPK LRATDLFSPAETEIDHVIERRM GGDGPDNLVLAHKDCNNAKGKK TPHEHAGDLLDSPALAALWQGW RKENADRLKGKGHKARTPREDK DFMDRVGWRFEEDARAKAEENQ ERRGRRMLHDTARATRLARLYL AAAVMPEDPAEIGAPPVETPPS PEDPTGYTAIYRTISRVQPVNG SVTHMLRQRLLQRDKNRDYQTH HAEDACLLLLAGPAVVQAFNTE AAQHGADAPDDRPVDLMPTSDA YHQQRRARALGRVPLATVDAAL ADIVMPESDRQDPETGRVHWRL TRAGRGLKRRIDDLTRNCVILS RPRRPSETGTPGALHNATHYGR REITVDGRTDTVVTQRMNARDL VALLDNAKIVPAARLDAAAPGD TILKEICTEIADRHDRVVDPEG THARRWISARLAALVPAHAEAV ARDIAELADLDALADADRTPEQ EARRSALRQSPYLGRAISAKKA DGRARAREQEILTRALLDPHWG PRGLRHLIMREARAPSLVRIRA NKTDAFGRPVPDAAVWVKTDGN AVSQLWRLTSVVTDDGRRIPLP KPIEKRIEISNLEYARINGLDE GAGVTGNNAPPRPLRQDIDRLT PLWRDHGTAPGGYLGTAVGELE DKARSALRGKAMRQTLTDAGIT AEAGWRLDSEGAVCDLEVAKGD TVKKDGKTYKVGVITQGIFGMP VDAAGSAPRTPEDCEKFEEQYG IKPWKAKGIPLA (SEQ ID NO: 44) | | | | | | | | | | |
| Eubacterium rectale ATCC 33656 gi\|238924075\|ref\| YP_002937591.1 | MNYTEKEKLFMKYILALDIGIA SVGWAILDKESETVIEAGSNIF PEASAADNQLRRDMRGAKRNNR RLKTRINDFIKLWENNNLSIPQ FKSTEIVGLKVRAITEEITLDE LYLILYSYLKHRGISYLEDALD DTVSGSSAYANGLKLNAKELET HYPCEIQQERLNTIGKYRGQSQ IINENGEVLDLSNVFTIGAYRK EIQRVFEIQKKYHPELTDEFCD GYMLIFNRKRKYYEGPGNEKSR TDYGRFTTKLDANGNYITEDNI FEKLIGKCSVYPDELRAAAASY | 133 | 185 | 53 | 322 | 384 | 60 | 322 | 384 | 60 |

TABLE 100-continued

Amino Acid Sequence of Cas9 Orthologs

| Species/ Composite ID | Amino acid sequence | REC2 start (AA pos) | REC2 stop (AA pos) | REC2 # AA deleted (n) | REC1$_{CT}$ start (AA pos) | REC1$_{CT}$ stop (AA pos) | REC1$_{CT}$ # AA deleted (n) | Rec$_{sub}$ start (AA pos) | Rec$_{sub}$ stop (AA pos) | Rec$_{sub}$ # AA deleted (n) |
|---|---|---|---|---|---|---|---|---|---|---|
| | TAQEYNVLNDLNNLTINGRKLE ENEKHEIVERIKSSNTINMRKI ISDCMGENIDDFAGARIDKSGK EIFHKFEVYNKMRKALLEIGID ISNYSREELDEIGYIMTINTDK EAMMEAFQKSWIDLSDDVKQCL INMRKTNGALENKWQSFSLKIM NELIPEMYAQPKEQMTLLTEMG VTKGTQEEFAGLKYIPVDVVSE DIFNPVVRRSVRISFKILNAVL KKYKALDTIVIEMPRDRNSEEQ KKRINDSQKLNEKEMEYIEKKL AVTYGIKLSPSDFSSQKQLSLK LKLWNEQDGICLYSGKTIDPND IINNPQLFEIDHIIPRSISFDD ARSNKVLVYRSENQKKGNQTPY YYLTHSHSEWSFEQYKATVMNL SKKKEYAISRKKIQNLLYSEDI TKMDVLKGFINRNINDTSYASR LVLNTIQNFFMANEADTKVKVI KGSYTHQMRCNLKLDKNRDESY SHHAVDAMLIGYSELGYEAYHK LQGEFIDFETGEILRKDMWDEN MSDEVYADYLYGKKWANIRNEV VKAEKNVKYWHYVMRKSNRGLC NQTIRGTREYDGKQYKINKLDI RTKEGIKVFAKLAFSKKDSDRE RLLVYLNDRRTFDDLCKIYEDY SDAANPFVQYEKETGDIIRKYS KKHNGPRIDKLKYKDGEVGACI DISHKYGFEKGSKKVILESLVP YRMDVYYKEENHSYYLVGVKQS DIKFEKGRNVIDEEAYARILVN EKMIQPGQSRADLENLGFKFKL SFYKNDIIEYEKDGKIYTERLV SRTMPKQRNYIETKPIDKAKFE KQNLVGLGKTKFIKKYRYDILG NKYSCSEEKFTSFC (SEQ ID NO: 45) | | | | | | | | | | |
| Mycoplasma synoviae53 gi\|71894592\| ref\| YP_278700.1\| | MLRLYCANNLVLNNVQNLWKYL LLLIFDKKIIFLFKIKVILIRR YMENNNKEKIVIGFDLGVASVG WSIVNAETKEVIDLGVRLFSEP EKADYRRAKRTTRRLLRRKKFK REKFHKLILKNAEIFGLQSRNE ILNVYKDQSSKYRNILKLKINA LKEEIKPSELVWILRDYLQNRG YFYKNEKLTDEFVSNSFPSKKL HEHYEKYGPFFRGSVKLDNKLDN KKDKAKEKDEEEESDAKKESEE LIFSNKQWINEIVKVFENQSYL TESFKEEYLKLFNYVRPFNKGP GSKNSRTAYGVFSTDIDPETNK FKDYSNIWDKTIGKCSLFEEEI RAPKNLPSALIFNLQNEICTIK NEFTEFKNWWLNAEQKSEILKF VFTELFNWKDKKYSDKKFNKNL QDKIKKYLLNFALENFNLNEEI LKNRDLENDTVLGLKGVKYYEK SNATADAALEFSSLKPLYVFIK FLKEKKLDLNYLIGLENTEILY FLDSIYLAISYSSDLKERNEWF KKLLKELYPKIKNNNLEIIENV EDIFEITDQEKFESFSKTHSLS REAFNHIIPLLLSNNEGKNYES LKHSNEELKKRTEKAELKAQQN QKYLKDNFLKEALVPLSVKTSV LQAIKIFNQIIKNFGKKYEISQ VVIEMARELTKPNLEKLLNNAT NSNIKILKEKLDQTEKFDDFTK KKFIDKIENSVVFRNKLFLWFE | 187 | 239 | 53 | 319 | 381 | 80 | 319 | 381 | 80 |

TABLE 100-continued

Amino Acid Sequence of Cas9 Orthologs

| Species/ Composite ID | Amino acid sequence | REC2 start (AA pos) | REC2 stop (AA pos) | REC2 # AA deleted (n) | REC1$_{CT}$ start (AA pos) | REC1$_{CT}$ stop (AA pos) | REC1$_{CT}$ # AA deleted (n) | Rec$_{sub}$ start (AA pos) | Rec$_{sub}$ stop (AA pos) | Rec$_{sub}$ # AA deleted (n) |
|---|---|---|---|---|---|---|---|---|---|---|
| | QDRKDPYTQLDIKINEIEDETE IDHVIPYSKSADDSWFNKLLVK KSTNQLKKNKTVWEYYQNESDP EAKWNKFVAWAKRIYLVQKSDK ESKDNSEKNSIFKNKKPNLKFK NITKKLFDPYKDLGFLARNLND TRYATKVFRDQLNNYSKHHSKD DENKLFKVVCMNGSITSFLRKS MWRKNEEQVYRFNFWKKDRDQF FHHAVDASIIAIFSLLTKTLYN KLRVYESYDVQRREDGVYLINK ETGEVKKADKDYWKDQHNFLKI RENAIEIKNVLNNVDFQNQVRY SRKANTKLNTQLFNETLYGVKE FENNFYKLEKVNLFSRKDLRKF ILEDLNEESEKNKKNENGSRKR ILTEKYIVDEILQILENEEFKD SKSDINALNKYMDSLPSKFSEF FSQDFINKCKKENSLILTFDAI KHNDPKKVIKIKNLKFFREDAT LKNKQAVHKDSKNQIKSFYESY KCVGFIWLKNKNDLEESIFVPI NSRVIHFGDKDKDIFDFDSYNK EKLLNEINLKRPENKKENSINE IEFVKFVKPGALLLNFENQQIY YISTLESSSLRAKIKLLNKMDK GKAVSMKKITNPDEYKIIEHVN PLGINLNWTKKLENNN (SEQ ID NO: 46) | | | | | | | | | | |
| Porphyromonas sp. oral taxon 279 str. F0450 gi\|402847315\| ref\| ZP_10895610.1 | MLMSKHVLGLDLGVGSIGWCLI ALDAQGDPAEILGMGSRVVPLN NATKAIEAFNAGAAFTASQERT ARRTMRRGFARYQLRRYRLRRE LEKVGMLPDAALIQLPLLELWE LRERAATAGRRLTLPELGRVLC HINQKRGYRHVKSDAAAIVGDE GEKKKDSNSAYLAGIRANDEKL QAEHKTVGQYFAEQLRQNQSES PTGGISYRIKDQIFSRQCYIDE YDQIMAVQRVHYPDILTDEFIR MLRDEVIFMQRPLKSCKHLVSL CEFEKQERVMRVQQDDGKGGWQ LVERRVKFGPKVAPKSSPLFQL CCIYEAVNNIRLTRPNGSPCDI TPEERAKIVAHLQSSASLSFAA LKKLLKEKALIADQLTSKSGLK GNSTRVALASALQPYPQYHHLL DMELETRMMTVQLTDEETGEVT EREVAVVTDSYVRKPLYRLWHI LYSIEEREAMRRALITQLGMKE EDLDGGLLDQLYRLDFVKPGYG NKSAKFICKLLPQLQQGLGYSE ACAAVGYRHSNSPTSEEITERT LLEKIPLLQRNELRQPLVEKIL NQMINLVNALKAEYGIDEVRVE LARELKMSREERERMARNNKDR EERNKGVAAKIRECGLYPTKPR IQKYMLWKEAGRQCLYCGRSIE EEQCLREGGMEVEHIIPKSVLY DDSYGNKTCACRRCNKEKGNRT ALEYIRAKGREAEYMKRINDLL KEKKISYSKHQRLRWLKEDIPS DFLERQLRLTQYISRQAMAILQ QGIRRVSASEGGVTARLRSLWG YGKILHTLNLDRYDSMGETERV SREGEATEELHITNWSKRMDHR HHAIDALVVACTRQSYIQRLNR LSSEFGREDKKKEDQEAQEQQA TETGRLSNLERWLTQRPHFSVR TVSDKVAEILISYRPGQRVVTR GRNIYRKKMADGREVSCVQRGV | 150 | 202 | 53 | 309 | 371 | 60 | 309 | 371 | 60 |

TABLE 100-continued

Amino Acid Sequence of Cas9 Orthologs

| Species/ Composite ID | Amino acid sequence | REC2 start (AA pos) | REC2 stop (AA pos) | REC2 # AA deleted (n) | REC1_{CT} start (AA pos) | REC1_{CT} stop (AA pos) | REC1_{CT} # AA deleted (n) | Rec_{sub} start (AA pos) | Rec_{sub} stop (AA pos) | Rec_{sub} # AA deleted (n) |
|---|---|---|---|---|---|---|---|---|---|---|
| | LVPRGELMEASFYGKILSQGRV RIVKRYPLHDLKGEVVDPHLRE LITTYNQELKSREKGAPIPPLC LDKDKKQEVRSVRCYAKTLSLD KAIPMCFDEKGEPTAFVKSASN HHLALYRTPKGKLVESIVTFWD AVDRARYGIPLVITHPREVMEQ VLQRGDIPEQVLSLLPPSDWVF VDSLQQDEMVVIGLSDEELQRA LEAQNYRKISEHLYRVQKMSSS YVVFRYHLETSVADDKNTSGRI PKFHRVQSLKAYEERNIRKVRV DLLGRISLL (SEQ ID NO: 47) | | | | | | | | | | |
| Streptococcus thermophilus LMD-9 gi\|116627542\| ref\| YP_820161.1\| | MSDLVLGLDIGIGSVGVGILNK VTGEIIHKNSRIFPAAQAENNL VRRTNRQGRRLARRKKHRRVRL NRLFEESGLITDFTKISININP YQLRVKGLTDELSNEELFIALK NMVKHRGISYLDDASDDGNSSV GDYAQIVKENSKQLETKTPGQI QLERYQTYGQLRGDFTVEKDGK KHRLINVFPTSAYRSEALRILQ TQQEFNPQITDEFINRYLEILT GKRKYYHGPGNEKSRTDYGRYR TSGETLDNIFGILIGKCTFYPD EFRAAKASYTAQEFNLLNDLNN LTVPTETKKLSKEQKNQIINYV KNEKAMGPAKLFKYIAKLLSCD VADIKGYRIDKSGKAEIHTFEA YRKMKTLETLDIEQMDRETLDK LAYVLTLNTEREGIQEALEHEF ADGSFSQKQVDELVQFRKANSS IFGKGWHNFSVKLMMELIPELY ETSEEQMTILTRLGKQKTTSSS NKTKYIDEKLLTEEIYNPVVAK SVRQAIKIVNAAIKEYGDFDNI VIEMARETNEDDEKKAIQKIQK ANKDEKDAAMLKAANQYNGKAE LPHSVFHGHKQLATKIRLWHQQ GERCLYTGKTISIHDLINNSNQ FEVDHILPLSITFDDSLANKVL VYATANQEKGQRTPYQALDSMD DAWSFRELKAFVRESKTLSNKK KEYLLTEEDISKFDVRKKFIER NLVDTRYASRVVLNALQEHFRA HKIDTKVSVVRGQFTSQLRRHW GIEKTRDTYHHHAVDALIIAAS SQLNLWKKQKNTLVSYSEDQLL DIETGELISDDEYKESVFKAPY QHFVDTLKSKEFEDSILFSYQV DSKFNRKISDATIYATRQAKVG KDKADETYVLGKIKDIYTQDGY DAFMKIYKKDKSKFLMYRHDPQ TFEKVIEPILENYPNKQINEKG KEVPCNPFLKYKEEHGYIRKYS KKGNGPEIKSLKYYDSKLGNHI DITPKDSNNKVVLQSVSPWRAD VYFNKTTGKYEILGLKYADLQF EKGTGTYKISQEKYNDIKKKEG VDSDSEFKFTLYKNDLLLVKDT ETKEQQLFRFLSRTMPKQKHYV ELKPYDKQKFEGGEALIKVLGN VANSGQCKKGLGKSNISIYKVR TDVLGNQHIIKNEGDKPKLDF (SEQ ID NO: 48) | 127 | 178 | 139 | 424 | 486 | 81 | 424 | 486 | 81 |
| Roseburia inulinivorans DSM 16841 gi\|225377804\| | MNAEHGKEGLLIMEENFQYRIG LDIGITSVGWAVLQNNSQDEPV RITDLGVRIFDVAENPKNGDAL AAPRRDARTTRRRLRRRHRLE | 154 | 204 | 51 | 318 | 380 | 69 | 318 | 380 | 69 |

TABLE 100-continued

Amino Acid Sequence of Cas9 Orthologs

| Species/ Composite ID | Amino acid sequence | REC2 | | | REC1$_{CT}$ | | | Rec$_{sub}$ | | |
|---|---|---|---|---|---|---|---|---|---|---|
| | | start (AA pos) | stop (AA pos) | # AA deleted (n) | start (AA pos) | stop (AA pos) | # AA deleted (n) | start (AA pos) | stop (AA pos) | # AA deleted (n) |
| ref\| ZP_03755025.1 | RIKFLLQENGLIEMDSFMERYY KGNLPDVYQLRYEGLDRKLKDE ELAQVLIHIAKHRGFRSTRKAE TKEKEGGAVLKATTENQKIMQE KGYRTVGEMLYLDEAFHTECLW NEKGYVLTPRNRPDDYKHTILR SMLVEEVHAIFAAQRAHGNQKA TEGLEEAYVEIMTSQRSFDMGP GLQPDGKPSPYAMEGFGDRVGK CTFEKDEYRAPKATYTAELFVA LQKINHTKLIDEFGTGRFFSEE ERKTIIGLLLSSKELKYGTIRK KLNIDPSLKFNSLNYSAKKEGE TEEERVLDTEKAKFASMFWTYE YSKCLKDRTEEMPVGEKADLFD RIGEILTAYKNDDSRSSRLKEL GLSGEEIDGLLDLSPAKYQRVS LKAMRKMQPYLEDGLIYDKACE AAGYDFRALNDGNKKHLLKGEE INAIVNDITNPVVKRSVSQTIK VINAIIQKYGSPQAVNIELARE MSKNFQDRTNLEKEMKKRQQEN ERAKQQIIELGKQNPTGQDILK YRLWNDQGGYCLYSGKKIPLEE LFDGGYDIDHILPYSITFDDSY RNKVLVTAQENRQKGNRTPYEY FGADEKRWEDYEASVRLLVRDY KKQQKLLKKNFTEEERKEFKER NLNDTKYITRVVYNMIRQNLEL EPFNHPEKKKQVWAVNGAVTSY LRKRWGLMQKDRSTDRHHAMDA VVIACCTDGMIHKISRYMQGRE LAYSRNFKFPDEETGEILNRDN FTREQWDEKFGVKVPLPWNSFR DELDIRLLNEDPKNFLLTHADV QRELDYPGWMYGEEESPIEEGR YINYIRPLFVSRMPNHKVTGSA HDATIRSARDYETRGVVITKVP LTDLKLNKDNEIEGYYDKDSDR LLYQALVRQLLLHGNDGKKAFA EDFHKPKADGTEGPVVRKVKIE KKQTSGVMVRGGTGIAANGEMV RIDVFRENGKYYFVPVYTADVV RKVLPNRAATHTKPYSEWRVMD DANFVFSLYSRDLIHVKSKKDI KTNLVNGGLLLQKEIFAYYTGA DIATASIAGFANDSNFKFRGLG IQSLEIFEKCQVDILGNISVVR HENRQEFH (SEQ ID NO: 49) | | | | | | | | | |
| Methylosinus trichosporium OB3b gi\|296446027\| ref\| ZP_06887976.1 | MRVLGLDAGIASLGWALIEIEE SNRGELSQGTIIGAGTWMFDAP EEKTQAGAKLKSEQRRTFRGQR RVVRRRRQRMNEVRRILHSHGL LPSSDRDALKQPGLDPWRIRAE ALDRLLGPVELAVALGHIARHR GFKSNSKGAKTNDPADDTSKMK RAVNETREKLARFGSAAKMLVE DESFVLRQTPTKNGASEIVRRF RNREGDYSRSLLRDDLAAEMRA LFTAQARFQSAIATADLQTAFT KAAFFQRPLQDSEKLVGPCPFE VDEKRAPKRGYSFELFRFLSRL NHVTLRDGKQERTLTRDELALA AADFGAAAKVSFTALRKKLKLP ETTVFVGVKADEESKLDVVARS GKAAEGTARLRSVIVDALGELA WGALLCSPEKLDKIAEVISFRS DIGRISEGLAQAGCNAPLVDAL TAAASDGRFDPFTGAGHISSKA ARNILSGLRQGMTYDKACCAAD | 144 | 193 | 50 | 426 | 488 | 64 | 426 | 488 | 64 |

TABLE 100-continued

Amino Acid Sequence of Cas9 Orthologs

| Species/ Composite ID | Amino acid sequence | REC2 start (AA pos) | REC2 stop (AA pos) | REC2 # AA deleted (n) | REC1_CT start (AA pos) | REC1_CT stop (AA pos) | REC1_CT # AA deleted (n) | Rec_sub start (AA pos) | Rec_sub stop (AA pos) | Rec_sub # AA deleted (n) |
|---|---|---|---|---|---|---|---|---|---|---|
| | YDHTASRERGAFDVGGHGREAL KRILQEERISRELVGSPTARKA LIESIKQVKAIVERYGVPDRIH VELARDVGKSIEEREEITRGIE KRNRQKDKLRGLFEKEVGRPPQ DGARGKEELLRFELWSEQMGRC LYTDDYISPSQLVATDDAVQVD HILPWSRFADDSYANKTLCMAK ANQDKKGRTPYEWFKAEKTDTE WDAFIVRVEALADMKGFKKRNY KLRNAEEAAAKFRNRNLNDTRW ACRLLAEALKQLYPKGEKDKDG KERRRVFSRPGALTDRLRRAWG LQWMKKSTKGDRIPDDRHHALD AIVIAATTESLLQRATREVQEI EDKGLHYDLVKNVTPPWPGFRE QAVEAVEKVFVARAERRRARGK AHDATIRHIAVREGEQRVYERR KVAELKLADLDRVKDAERNARL IEKLRNWIEAGSPKDDPPLSPK GDPIFKVRLVTKSKVNIALDTG NPKRPGTVDRGEMARVDVFRKA SKKGKYEYYLVPIYPHDIATMK TPPIRAVQAYKPEDEWPEMDSS YEFCWSLVPMTYLQVISSKGEI FEGYYRGMNRSVGAIQLSAHSN SSDVVQGIGARTLTEFKKENVD RFGRKHEVERELRTWRGETWRG KAYI (SEQ ID NO: 50) | | | | | | | | | | |
| Ruminococcus albus 8 gi\|325677756\| ref\| ZP_08157403.1 | MGNYYLGLDVGIGSIGWAVINI EKKRIEDFNVRIFKSGEIQEKN RNSRASQQCRRSRGLRRLYRRK SHRKLRLKNYLSIIGLTTSEKI DYYYETADNNVIQLRNKGLSEK LTPEEIAACLIHICNNRGYKDF YEVNVEDIEDPDERNEYKEEHD SIVLISNLMNEGGYCTPAEMIC NCREFDEPNSVYRKFHNSAASK NHYLITRHMLVKEVDLILENQS KYYGILDDKTIAKIKDIIFAQR DFEIGPGKNERFRRFTGYLDSI GKCQFFKDQERGSRFTVIADIY AFVNVLSQYTYTNNRGESVFDT SFANDLINSALKNGSMDKRELK AIAKSYHIDISDKNSDTSLTKC FKYIKVVKPLFEKYGYDWDKLI ENYTDTDNNVLNRIGIVLSQAQ TPKRRREKLKALNIGLDDGLIN ELTKLKLSGTANVSYKYMQGSI EAFCEGDLYGKYQAKFNKEIPD IDENAKPQKLPPFKNEDDCEFF KNPVVFRSINETRKLINAIIDK YGYPAAVNIETADELNKTFEDR AIDTKRNNDNQKENDRIVKEII ECIKCDEVHARHLIEKYKLWEA QEGKCLYSGETITKEDMLRDKD KLFEVDHIVPYSLILDNTINNK ALVYAEENQKKGQRTPLMYMNE AQAADYRVRVNTMFKSKKCSKK KYQYLMLPDLNDQELLGGWRSR NLNDTRYICKYLVNYLRKNLRF DRSYESSDEDDLKIRDHYRVFP VKSRFTSMFRRWWLNEKTWGRY DKAELKKLTYLDHAADAIIIAN CRPEYVVLAGEKLKLNKMYHQA GKRITPEYEQSKKACIDNLYKL FRMDRRTAEKLLSGHGRLTPII PNLSEEVDKRLWDKNIYEQFWK DDKDKKSCEELYRENVASLYKG DPKFASSLSMPVISLKPDHKYR GTITGEEAIRVKEIDGKLIKLK | 139 | 187 | 49 | 351 | 412 | 55 | 351 | 412 | 55 |

TABLE 100-continued

Amino Acid Sequence of Cas9 Orthologs

| Species/ Composite ID | Amino acid sequence | REC2 start (AA pos) | REC2 stop (AA pos) | REC2 # AA deleted (n) | REC1$_{CT}$ start (AA pos) | REC1$_{CT}$ stop (AA pos) | REC1$_{CT}$ # AA deleted (n) | Rec$_{sub}$ start (AA pos) | Rec$_{sub}$ stop (AA pos) | Rec$_{sub}$ # AA deleted (n) |
|---|---|---|---|---|---|---|---|---|---|---|
| | RKSISEITAESINSIYTDDKIL IDSLKTIFEQADYKDVGDYLKK TNQHFFTTSSGKRVNKVTVIEK VPSRWLRKEIDDNNFSLLNDSS YYCIELYKDSKGDNNLQGIAMS DIVHDRKTKKLYLKPDFNYPDD YYTHVMYIFPGDYLRIKSTSKK SGEQLKFEGYFISVKNVNENSF RFISDNKPCAKDKRVSITKKDI VIKLAVDLMGKVQGENNGKGIS CGEPLSLLKEKN (SEQ ID NO: 51) | | | | | | | | | |
| Bifidobacterium longum DJO10A gi\|189440764\| ref\| YP_001955845. | MLSRQLLGASHLARPVSYSYNV QDNDVHCSYGERCFMRGKRYRI GIDVGLNSVGLAAVEVSDENSP VRLLNAQSVIHDGGVDPQKNKE AITRKNMSGVARRTRRMRRRKR ERLHKLDMLLGKFGYPVIEPES LDKPFEEWHVRAELATRYIEDD ELRRESISIALRHMARHRGWRN PYRQVDSLISDNPYSKQYGELK EKAKAYNDDATAAEEESTPAQL VVAMLDAGYAEAPRLRWRTGSK KPDAEGYLPVRLMQEDNANELK QIFRVQRVPADEWKPLFRSVFY AVSPKGSAEQRVGQDPLAPEQA RALKASLAFQEYRIANVITNLR IKDASAELRKLTVDEKQSIYDQ LVSPSSEDITWSDLCDFLGFKR SQLKGVGSLTEDGEERISSRPP RLTSVQRIYESDNKIRKPLVAW WKSASDNEHEAMIRLLSNTVDI DKVREDVAYASAIEFIDGLDDD ALTKLDSVDLPSGRAAYSVETL QKLTRQMLTTDDDLHEARKTLF NVTDSWRPPADPIGEPLGNPSV DRVLKNVNRYLMNCQQRWGNPV SVNIEHVRSSFSSVAFARKDKR EYEKNNEKRSIFRSSLSEQLRA DEQMEKVRESDLRRLEAIQRQN GQCLYCGRTITFRTCEMDHIVP RKGVGSTNTRTNFAAVCAECNR MKSNTPFAIWARSEDAQTRGVS LAEAKKRVTMFTFNPKSYAPRE VKAFKQAVIARLQQTEDDAAID NRSIESVAWMADELHRRIDWYF NAKQYVNSASIDDAEAETMKTT VSVFQGRVTASARRAAGIEGKI HFIGQQSKTRLDRRHHAVDASV IAMMNTAAAQTLMERESLRESQ RLIGLMPGERSWKEYPYEGTSR YESFHLWLDNMDVLLELLNDAL DNDRIAVMQSQRYVLGNSIAHD ATIHPLEKVPLGSAMSADLIRR ASTPALWCALTRLPDYDEKEGL PEDSHREIRVHDTRYSADDEMG FFASQAAQIAVQEGSADIGSAI HHARVYRCWKTNAKGVRKYFYG MIRVFQTDLLRACHDDLFTVPL PPQSISMRYGEPRVVQALQSGN AQYLGSLVVGDEIEMDFSSLDV DGQIGEYLQFFSQFSGGNLAWK HWVVDGFFNQTQLRIRPRYLAA EGLAKAFSDDVVPDGVQKIVTK QGWLPPVNTASKTAVRIVRRNA FGEPRLSSAHHMPCSWQWRHE (SEQ ID NO: 52) | 183 | 230 | 48 | 370 | 431 | 44 | 370 | 431 | 44 |
| Enterococcus faecalis TX0012 | MYSIGLDLGISSVGWSVIDERT GNVIDLGVRLFSAKNSEKNLER RTNRGGRRLIRRKTNRLKDAKK | 123 | 170 | 48 | 327 | 387 | 60 | 327 | 387 | 60 |

TABLE 100-continued

Amino Acid Sequence of Cas9 Orthologs

| Species/ Composite ID | Amino acid sequence | REC2 start (AA pos) | REC2 stop (AA pos) | REC2 # AA deleted (n) | REC1$_{CT}$ start (AA pos) | REC1$_{CT}$ stop (AA pos) | REC1$_{CT}$ # AA deleted (n) | Rec$_{sub}$ start (AA pos) | Rec$_{sub}$ stop (AA pos) | Rec$_{sub}$ # AA deleted (n) |
|---|---|---|---|---|---|---|---|---|---|---|
| gi\|315149830\| gb\| EFT93846.1\| | ILAAVGFYEDKSLKNSCPYQLR VKGLTEPLSRGEIYKVTLHILK KRGISYLDEVDTEAAKESQDYK EQVRKNAQLLTKYTPGQIQLQR LKENNRVKTGINAQGNYQLNVF KVSAYANELATILKTQQAFYPN ELTDDWIALFVQPGIAEEAGLI YRKRPYYHGPGNEANNSPYGRW SDFQKTGEPATNIFDKLIGKDF QGELRASGLSLSAQQYNLLNDL TNLKIDGEVPLSSEQKEYILTE LMTKEFTRFGVNDVVKLLGVKK ERLSGWRLDKKGKPEIHTLKGY RNWRKIFAEAGIDLATLPTETI DCLAKVLTLNTEREGIENTLAF ELPELSESVKLLVLDRYKELSQ SISTQSWHRFSLKTLHLLIPEL MNATSEQNTLLEQFQLKSDVRK RYSEYKKLPTKDVLAEIYNPTV NKTVSQAFKVIDALLVKYGKEQ IRYITIEMPRDDNEEDEKKRIK ELHAKNSQRKNDSQSYFMQKSG WSQEKFQTTIQKNRRFLAKLLY YYEQDGICAYTGLPISPELLVS DSTEIDHIIPISISLDDSINNK VLVLSKANQVKGQQTPYDAWMD GSFKKINGKFSNWDDYQKWVES RHFSHKKENNLLETRNIFDSEQ VEKFLARNLNDTRYASRLVLNT LQSFFTNQETKVRVVNGSFTHT LRKKWGADLDKTRETHHHHAVD ATLCAVTSFVKVSRYHYAVKEE TGEKVMREIDFETGEIVNEMSY WEFKKSKKYERKTYQVKWPNFR EQLKPVNLHPRIKFSHQVDRKA NRKLSDATIYSVREKTEVKTLK SGKQKITTDEYTIGKIKDIYTL DGWEAFKKKQDKLLMKDLDEKT YERLLSIAETTPDFQEVEEKNG KVKRVKRSPFAVYCEENDIPAI QKYAKKNNGPLIRSLKYYDGKL NKHINITKDSQGRPVEKTKNGR KVTLQSLKPYRYDIYQDLETKA YYTVQLYYSDLRFVEGKYGITE KEYMKKVAEQTKGQVVRFCFSL QKNDGLEIEWKDSQRYDVRFYN FQSANSINFKGLEQEMMPAENQ FKQKPYNNGAINLNIAKYGKEG KKLRKFNTDILGKKHYLFYEKE PKNIIK (SEQ ID NO: 53) | | | | | | | | | | |
| Mycoplasma mobile 163K gi\|47458868\| ref\| YP_015730.1\| | MYFYKNKENKLNKKVVLGLDLG IASVGWCLTDISQKEDNKFPII LHGVRLFETVDDSDDKLLNETR RKKRGQRRRNRRLFTRKRDFIK YLIDNNIIELEFDKNPKILVRN FIEKYINPFSKNLELKYKSVTN LPIGFHNLRKAAINEKYKLDKS ELIVLLYFYLSLRGAFFDNPED TKSKEMNKNEIEIFDKNESIKN AEFPIDKIIEFYKISGKIRSTI NLKFGHQDYLKEIKQVFEKQNI DFMNYEKFAMEEKSFFSRIRNY SEGPGNEKSFSKYGLYANENGN PELIINEKGQKIYTKIFKTLWE SKIGKCSYDKKLYRAPKNSFSA KVFDITNKLTDWKHKNEYISER LKRKILLSRFLNKDSKSAVEKI LKEENIKFENLSEIAYNKDDNK INLPIINAYHSLTTIFKKHLIN FENYLISNENDLSKLMSFYKQQ SEKLFVPNEKGSYEINQNNNVL | 179 | 226 | 48 | 314 | 374 | 79 | 314 | 374 | 79 |

TABLE 100-continued

Amino Acid Sequence of Cas9 Orthologs

| Species/ Composite ID | Amino acid sequence | REC2 start (AA pos) | REC2 stop (AA pos) | REC2 # AA deleted (n) | REC1$_{CT}$ start (AA pos) | REC1$_{CT}$ stop (AA pos) | REC1$_{CT}$ # AA deleted (n) | Rec$_{sub}$ start (AA pos) | Rec$_{sub}$ stop (AA pos) | Rec$_{sub}$ # AA deleted (n) |
|---|---|---|---|---|---|---|---|---|---|---|
| | HIFDAISNILNKFSTIQDRIRI LEGYFEFSNLKKDVKSSEIYSE IAKLREFSGTSSLSFGAYYKFI PNLISEGSKNYSTISYEEKALQ NQKNNFSHSNLFEKTWVEDLIA SPTVKRSLRQTMNLLKEIFKYS EKNNLEIEKIVVEVTRSSNNKH ERKKIEGINKYRKEKYEELKKV YDLPNENTTLLKKLWLLRQQQG YDAYSLRKIEANDVINKPWNYD IDHIVPRSISFDDSFSNLVIVN KLDNAKKSNDLSAKQFIEKIYG IEKLKEAKENWGNWYLRNANGK AFNDGKFIKLYTIDNLDEFDN SDFINRNLSDTSYITNALVNHL TFSNSKYKYSVVSVNGKQTSNL RNQIAFVGIKNNKETEREWKRP EGFKSINSNDFLIREEGKNDVK DDVLIKDRSFNGHHAEDAYFIT IISQYFRSFKRIERLNVNYRKE TRELDDLEKNNIKFKEKASFDN FLLINALDELNEKLNQMRFSRM VITKKNTQLFNETLYSGKYDKG KNTIKKVEKLNLLDNRTDKIKK IEEFFDEDKLKENELTKLHIFN HDKNLYETLKIIWNEVKIEIKN KNLNEKNYFKYFVNKKLQEGKI SFNEWVPILDNDFKIIRKIRYI KFSSEEKETDEIIFSQSNFLKI DQRQNFSFHNTLYWVQIWVYKN QKDQYCFISIDARNSKFEKDEI KINYEKLKTQKEKLQIINEEPI LKINKGDLFENEEKELFYIVGR DEKPQKLEIKYILGKKIKDQKQ IQKPVKKYFPNWKKVNLTYMGE IFKK (SEQ ID NO: 54) | | | | | | | | | |
| Actinomyces coleocanis DSM 15436 gi\|227494853\| ref\| ZP_03925169.1 | MDKNYRIGIDVGLNSIGFCAV EVDQHDTPLGFLNLSVYRHDAG IDPNGKKTNTTRLAMSGVARRT RRLFRKRKRRLAALDRFIEAQG WTLPDHADYKDPYTPWLVRAEL AQTPIRDENDLHEKLAIAVRHI ARHRGWRSPWVPVRSLHVEQPP SDQYLALKERVEAKTLLQMPEG ATPAEMVVALDLSVDVNLRPKN REKTDTRPENKKPGFLGGKLMQ SDNANELRKIAKIQGLDDALLR ELIELVFAADSPKGASGELVGY DVLPGQHGKRRAEKAHPAFQRY RIASIVSNLRIRHLGSGADERL DVETQKRVFEYLLNAKPTADIT WSDVAEEIGVERNLLMGTATQT ADGERASAKPPVDVTNVAFATC KIKPLKEWWLNADYEARCVMVS ALSHAEKLTEGTAAEVEVAEFL QNLSDEDNEKLDSFSLPIGRAA YSVDSLERLTKRMIENGEDLFE ARVNEFGVSEDWRPPAEPIGAR VGNPAVDRVLKAVNRYLMAAEA EWGAPLSVNIEHVREGFISKRQ AVEIDRENQKRYQRNQAVRSQI ADHINATSGVRGSDVTRYLAIQ RQNGECLYCGTAITFVNSEMDH IVPRAGLGSTNTRDNLVATCER CNKSKSNKPFAVWAAECGIPGV SVAEALKRVDFWIADGFASSKE HRELQKGVKDRLKRKVSDPEID NRSMESVAWMARELAHRVQYYF DEKHTGTKVRVFRGSLTSAARK ASGFESRVNFIGGNGKTRLDRR HHAMDAATVAMLRNSVAKTLVL | 147 | 193 | 47 | 358 | 418 | 40 | 358 | 418 | 40 |

TABLE 100-continued

Amino Acid Sequence of Cas9 Orthologs

| Species/ Composite ID | Amino acid sequence | REC2 | | | REC1$_{CT}$ | | | Rec$_{sub}$ | | |
|---|---|---|---|---|---|---|---|---|---|---|
| | | start (AA pos) | stop (AA pos) | # AA deleted (n) | start (AA pos) | stop (AA pos) | # AA deleted (n) | start (AA pos) | stop (AA pos) | # AA deleted (n) |
| | RGNIRASERAIGAAETWKSFRG ENVADRQIFESWSENMRVLVEK FNLALYNDEVSIFSSLRLQLGN GKAHDDTITKLQMHKVGDAWSL TEIDRASTPALWCALTRQPDFT WKDGLPANEDRTIIVNGTHYGP LDKVGIFGKAAASLLVRGGSVD IGSAIHHARIYRIAGKKPTYGM VRVFAPDLLRYRNEDLENVELP PQSVSMRYAEPKVREAIREGKA EYLGWLVVGDELLLDLSSETSG QIAELQQDFPGTTHWTVAGFFS PSRLRLRPVYLAQEGLGEDVSE GSKSIIAGQGWRPAVNKVFGSA MPEVIRRDGLGRKRRFSYSGLP VSWQG (SEQ ID NO: 55) | | | | | | | | | |
| Dinoroseobacter shibae DFL 12 gi\|159042956\| ref\| YP_001531750.1 | MRLGLDIGTSSIGWWLYETDGA GSDARITGVVDGGVRIFSDGRD PKSGASLAVDRRAARAMRRRRD RYLRRRATLMKVLAETGLMPAD PAEAKALEALDPFALRAAGLDE PLPLPHLGRALFHLNQRRGFKS NRKTDRGDNESGKIKDATARLD MEMMANGARTYGEFLHKRRQKA TDPRHVPSVRTRLSIANRGGPD GKEEAGYDFYPDRRHLEEEFHK LWAAQGAHHPELTETLRDLLFE KIFFQRPLKEPEVGLCLFSGHH GVPPKDPRLPKAHPLTQRRVLY ETVNQLRVTADGREARPLTREE RDQVIHALDNKKPTKSLSSMVL KLPALAKVLKLRDGERFTLETG VRDAIACDPLRASPAHPDRFGP RWSILDADAQWEVISRIRRVQS DAEHAALVDWLTEAHGLDRAHA EATAHAPLPDGYRLGLTATTR ILYQLTADVVTYADAVKACGWH HSDGRTGECFDRLPYYGEVLER HVIPGSYHPDDDDITRFGRITN PTVHIGLNQLRRLVNRIIETHG KPHQIVVELARDLKKSEEQKRA DIKRIRDTTEAAKKRSEKLEEL EIEDNGRNRMLLRLWEDLNPDD AMRRFCPYTGTRISAAMIFDGS CDVDHILPYSRTLDDSFPNRTL CLREANRQKRNQTPWQAWGDTP HWHAIAANLKNLPENKRWRFAP DAMTRFEGENGFLDRALKDTQY LARISRSYLDTLFTKGGHVWVV PGRFTEMLRRHWGLNSLLSDAG RGAVKAKNRTDHRHHAIDAAVI AATDPGLLNRISRAAGQGEAAG QSAELIARDTPPPWEGFRDDLR VRLDRIIVSHRADHGRIDHAAR KQGRDSTAGQLHQETAYSIVDD IHVASRTDLLSLKPAQLLDEPG RSGQVRDPQLRKALRVATGGKT GKDFENALRYFASKPGPYQAIR RVRIIKPLQAQARVPVPAQDPI KAYQGGSNHLFEIWRLPDGEIE AQVITSFEAHTLEGEKRPHPAA KRLLRVHKGDMVALERDGRRVV GHVQKMDIANGLFIVPHNEANA DTRNNDKSDPFKWIQIGARPAI ASGIRRVSVDEIGRLRDGGTRP I (SEQ ID NO: 56) | 138 | 184 | 47 | 338 | 398 | 48 | 338 | 398 | 48 |
| Actinomyces sp. oral taxon 180 str. F0310 | MLHCIAVIRVPPSEEPGFFETH ADSCALCHHGCMTYAANDKAIR YRVGIDVGLRSIGFCAVEVDDE DHPIRILNSVVHVHDAGTGGPG | 183 | 228 | 46 | 349 | 409 | 40 | 349 | 409 | 40 |

TABLE 100-continued

Amino Acid Sequence of Cas9 Orthologs

| Species/ Composite ID | Amino acid sequence | REC2 | | | REC1$_{CT}$ | | | Rec$_{sub}$ | | |
|---|---|---|---|---|---|---|---|---|---|---|
| | | start (AA pos) | stop (AA pos) | # AA deleted (n) | start (AA pos) | stop (AA pos) | # AA deleted (n) | start (AA pos) | stop (AA pos) | # AA deleted (n) |
| gi\|315605738\| ref\| 8ZP_0780770.1 | ETESLRKRSGVAARARRRGRAE KQRLKKLDVLLEELGWGVSSNE LLDSHAPWHIRKRLVSEYIEDE TERRQCLSVAMAHIARHRGWRN SFSKVDTLLLEQAPSDRMQGLK ERVEDRTGLQFSEEVTQGELVA TLLEHDGDVTIRGFVRKGGKAT KVHGVLEGKYMQSDLVAELRQI CRTQRVSETTFEKLVLSIFHSK EPAPSAARQRERVGLDELQLAL DPAAKQPRAERAHPAFQKFKVV ATLANMRIREQSAGERSLTSEE LNRVARYLLNHTESESPTWDDV ARKLEVPRHRLRGSSRASLETG GGLTYPPVDDTTVRVMSAEVDW LADWWDCANDESRGHMIDAISN GCGSEPDDVEDEEVNELISSAT AEDMLKLELLAKKLPSGRVAYS LKTLREVTAAILETGDDLSQAI TRLYGVDPGWVPTPAPIEAPVG NPSVDRVLKQVARWLKFASKRW GVPQTVNIEHTREGLKSASLLE EERERWERFEARREIRQKEMYK RLGISGPFRRSDQVRYEILDLQ DCACLYCGNEINFQTFEVDHII PRVDASSDSRRTNLAAVCHSCN SAKGGLAFGQWVKRGDCPSGVS LENAIKRVRSWSKDRLGLTEKA MGKRKSEVISRLKTEMPYEEFD GRSMESVAWMAIELKKRIEGYF NSDRPEGCAAVQVNAYSGRLTA CARRAAHVDKRVRLIRLKGDDG HHKNRFDRRNHAMDALVIALMT PAIARTIAVREDRREAQQLTRA FESWKNFLGSEERMQDRWESWI GDVEYACDRLNELIDADKIPVT ENLRLRNSGKLHADQPESLKKA RRGSKRPRPQRYVLGDALPADV INRVTDPGLWTALVRAPGFDSQ LGLPADLNRGLKLRGKRISADF PIDYFPTDSPALAVQGGYVGLE FHHARLYRIIGPKEKVKYALLR VCAIDLCGIDCDDLFEVELKPS SISMRTADAKLKEAMGNGSAKQ IGWLVLGDEIQIDPTKFPKQSI GKFLKECGPVSSWRVSALDTPS KITLKPRLLSNEPLLKTSRVGG HESDLVVAECVEKIMKKTGWVV EINALCQSGLIRVIRRNALGEV RTSPKSGLPISLNLR (SEQ ID NO: 57) | | | | | | | | | |
| Alcanivorax sp. W11-5 gi\|407803669\| ref\| ZP_11150502.1 | MRYRVGLDLGTASVGAAVFSMD EQGNPMELIWHYERLFSEPLVP DMGQLKPKKAARRLARQQRRQI DRRASRLRRIAIVSRRLGIAPG RNDSGVHGNDVPTLRAMAVNER IELGQLRAVLLRMGKKRGYGGT FKAVRKVGEAGEVASGASRLEE EMVALASVQNKDSVTVGEYLAA RVEHGLPSKLKVAANNEYYAPE YALFRQYLGLPAIKGRPDCLPN MYALRHQIEHEFERIWATQSQF HDVMKDHGVKEEIRNAIFFQRP LKSPADKVGRCSLQTNLPRAPR AQIAAQNFRIEKQMADLRWGMG RRAEMLNDHQKAVIRELLNQQK ELSFRKIYKELERAGCPGPEGK GLNMDRAALGGRDDLSGNTTLA AWRKLGLEDRWQELDEVTQIQV INFLADLGSPEQLDTDDWSCRF MGKNGRPRNFSDEFVAFMNELR | 139 | 183 | 45 | 344 | 404 | 61 | 344 | 404 | 61 |

TABLE 100-continued

Amino Acid Sequence of Cas9 Orthologs

| Species/<br>Composite<br>ID | Amino acid sequence | REC2 start (AA pos) | REC2 stop (AA pos) | REC2 # AA deleted (n) | REC1$_{CT}$ start (AA pos) | REC1$_{CT}$ stop (AA pos) | REC1$_{CT}$ # AA deleted (n) | Rec$_{sub}$ start (AA pos) | Rec$_{sub}$ stop (AA pos) | Rec$_{sub}$ # AA deleted (n) |
|---|---|---|---|---|---|---|---|---|---|---|
| | MTDGFDRLSKMGFEGGRSSYSI<br>KALKALTEWMIAPHWRETPETH<br>RVDEEAAIRECYPESLATPAQG<br>GRQSKLEPPPLTGNEVVDVALR<br>QVRHTINMMIDDLGSVPAQIVV<br>EMAREMKGGVTRRNDIEKQNKR<br>FASERKKAAQSIEENGKTPTPA<br>RILRYQLWIEQGHQCPYCESNI<br>SLEQALSGAYTNFEHILPRTLT<br>QIGRKRSELVLAHRECNDEKGN<br>RTPYQAFGHDDRRWRIVEQRAN<br>ALPKKSSRKTRLLLLKDFEGEA<br>LTDESIDEFADRQLHESSWLAK<br>VTTQWLSSLGSDVYVSRGSLTA<br>ELRRRWGLDTVIPQVRFESGMP<br>VVDEEGAEITPEEFEKFRLQWE<br>GHRVTREMRTDRRPDKRIDHRH<br>HLVDAIVTALTSRSLYQQYAKA<br>WKVADEKQRHGRVDKVELPMP<br>ILTIRDIALEAVRSVRISHKPD<br>RYPDGRFFEATAYGIAQRLDER<br>SGEKVDWLVSRKSLTDLAPEKK<br>SIDVDKVRANISRIVGEAIRLH<br>ISNIFEKRVSKGMTPQQALREP<br>IEFQGNILRKVRCFYSKADDCV<br>RIEHSSRRGHHYKMLLNDGFAY<br>MEVPCKEGILYGVPNLVRPSEA<br>VGIKRAPESGDFIRFYKGDTVK<br>NIKTGRVYTIKQILGDGGGKLI<br>LTPVTETKPADLLSAKWGRLKV<br>GGRNIHLLRLCAE (SEQ ID<br>NO: 58) | | | | | | | | | |
| Aminomonas<br>paucivorans<br>DSM 12260<br>gi\|312879015\|<br>ref\|<br>ZP_07738815.1 | MIGEHVRGGCLFDDHWTPNWGA<br>FRLPNTVRTFTKAENPKDGSSL<br>AEPRRQARGLRRRLRRKTQRLE<br>DLRRLLAKEGVLSLSDLETLFR<br>ETPAKDPYQLRAEGLDRPLSFP<br>EWVRVLYHITKHRGFQSNRRNP<br>VEDGQERSRQEEEGKLLSGVGE<br>NERLLREGGYRTAGEMLARDPK<br>FQDHRRNRAGDYSHTLSRSLLL<br>EEARRLFQSQRTLGNPHASSNL<br>EEAFLHLVAFQNPFASGEDIRN<br>KAGHCSLEPDQIRAPRRSASAE<br>TFMLLQKTGNLRLIHRRTGEER<br>PLTDKEREQIHLLAWKQEKVTH<br>KTLRRHLEIPEEWLFTGLPYHR<br>SGDKAEEKLFVHLAGIHEIRKA<br>LDKGPDPAVWDTLRSRRDLLDS<br>IADTLTFYKNEDEILPRLESLG<br>LSPENARALAPLSFSGTAHLSL<br>SALGKLLPHLEEGKSYTQARAD<br>AGYAAPPPDRHPKLPPLEEADW<br>RNPVVFRALTQTRKVVNALVRR<br>YGPPWCIHLETARELSQPAKVR<br>RRIETEQQANEKKKQQAEREFL<br>DIVGTAPGPGDLLKMRLWREQG<br>GFCPYCEEYLNPTRLAEPGYAE<br>MDHILPYSRSLDNGWHNRVLVH<br>GKDNRDKGNRTPFEAFGGDTAR<br>WDRLVAWVQASHLSAPKKRNLL<br>REDFGEEAERELKDRNLTDTRF<br>ITKTAATLLRDRLTFHPEAPKD<br>PVMTLNGRLTAFLRKQWGLHKN<br>RKNGDLHHALDAAVLAVASRSF<br>VYRLSSHNAAWGELPRGREAEN<br>GFSLPYPAFRSEVLARLCPTRE<br>EILLRLDQGGVGYDEAFRNGLR<br>PVFVSRAPSRRLRGKAHMETLR<br>SPKWKDHPEGPRTASRIPLKDL<br>NLEKLERMVGKDRDRKLYEALR | 134 | 178 | 45 | 341 | 401 | 63 | 341 | 401 | 63 |

TABLE 100-continued

Amino Acid Sequence of Cas9 Orthologs

| Species/ Composite ID | Amino acid sequence | REC2 | | | REC1$_{CT}$ | | | Rec$_{sub}$ | | |
|---|---|---|---|---|---|---|---|---|---|---|
| | | start (AA pos) | stop (AA pos) | # AA deleted (n) | start (AA pos) | stop (AA pos) | # AA deleted (n) | start (AA pos) | stop (AA pos) | # AA deleted (n) |
| | ERLAAFGGNGKKAFVAPFRKPC RSGEGPLVRSLRIFDSGYSGVE LRDGGEVYAVADHESMVRVDVY AKKNRFYLVPVYVADVARGIVK NRAIVAHKSEEEWDLVDGSFDF RFSLFPGDLVEIEKKDGAYLGY YKSCHRGDGRLLLDRHDRMPRE SDCGTFYVSTRKDVLSMSKYQV DPLGEIRLVGSEKPPFVL (SEQ ID NO: 59) | | | | | | | | | |
| Mycoplasma canis PG 14 gi\|384393286\| gb\|EIE39736.1\| | MEKKRKVTLGFDLGIASVGWAI VDSETNQVYKLGSRLFDAPDTN LERRTQRGTRRLLRRRKYRNQK FYNLVKRTEVFGLSSREAIENR FRELSIKYPNIIELKTKALSQE VCPDEIAWILHDYLKNRGYFYD EKETKEDFDQQTVESMPSYKLN EFYKKYGYPKGALSQPTESEMK DNKDLKEAFFFDFSNKEWLKEI NYFFNVQKNILSETFIEEFKKI FSFTRDISKGPGSDNMPSPYGI FGEFGDNQGGRYEHIWDKNIG KCSIFTNEQRAPKYLPSALIFN FLNELANIRLYSTDKKNIQPLW KLSSVDKLNILLNLFNLPISEK KKKLTSTNINDIVKKESIKSIM ISVEDIDMIKDEWAGKEPNVYG VGLSGLNIEESAKENKFKFQDL KILNVLINLLDNVGIKFEFKDR NDIIKNLELLDNLYLFLIYQKE SNNKDSSIDLFIAKNESLNIEN LKLKLKEFLLGAGNEFENHNSK THSLSKKAIDEILPKLLDNNEG WNLEAIKNYDEEIKSQIEDNSS LMAKQDKKYLNDNFLKDAILPP NVKVTFQQAILIFNKIIQKFSK DFEIDKVVIELAREMTQDQEND ALKGIAKAQKSKKSLVEERLEA NNIDKSVENDKYEKLIYKIFLW ISQDFKDPYTGAQISVNEIVNN KVEIDHIIPYSLCFDDSSANKV LVHKQSNQEKSNSLPYEYIKQG HSGWNWDEFTKYVKRVFVNNVD SILSKKERLKKSENLLTASYDG YDKLGFLARNLNDTRYATILFR DQLNNYAEHHLIDNKKMFKVIA MNGAVTSFIRKNMSYDNKLRLK DRSDFSHHAYDAAIIALFSNKT KTLYNLIDPSLNGIISKRSEGY WVIEDRYTGEIKELKKEDWTSI KNNVQARKIAKEIEEYLIDLDD EVFFSRKTKRKTNRQLYNETIY GIATKTDEDGITNYYKKEKFSI LDDKDIYLRLLREREKFVINQS NPEVIDQIIEIIESYGKENNIP SRDEAINIKYTKNKINYNLYLK QYMRSLTKSLDQFSEEFINQMI ANKTFVLYNPTKNTTRKIKFLR LVNDVKINDIRKNQVINKENGK NNEPKAFYENINSLGAIVFKNS ANNFKTLSINTQIAIFGDKNWD IEDFKTYNMEKIEKYKEIYGID KTYNFHSFIFPGTILLDKQNKE FYYISSIQTVRDIIEIKFLNKI EFKDENKNQDTSKTPKRLMFGI KSIMNNYEQVDISPFGINKKIF E (SEQ ID NO: 60) | 139 | 183 | 45 | 319 | 379 | 76 | 319 | 379 | 76 |
| Lactobacillus coryniformis KCTC 3535 | MGYRIGLDVGITSTGYAVLKTD KNGLPYKILTLDSVIYPRAENP QTGASLAEPRRIKRGLRRRTRR | 141 | 184 | 44 | 328 | 387 | 61 | 328 | 387 | 61 |

TABLE 100-continued

Amino Acid Sequence of Cas9 Orthologs

| Species/ Composite ID | Amino acid sequence | REC2 | | | REC1$_{CT}$ | | | Rec$_{sub}$ | | |
|---|---|---|---|---|---|---|---|---|---|---|
| | | start (AA pos) | stop (AA pos) | # AA deleted (n) | start (AA pos) | stop (AA pos) | # AA deleted (n) | start (AA pos) | stop (AA pos) | # AA deleted (n) |
| gi\|336393381\| ref\| ZP_08574780.1 | TKFRKQRTQQLFIHSGLLSKPE IEQILATPQAKYSVYELRVAGL DRRLTNSELFRVLYFFIGHRGF KSNRKAELNPENEADKKQMGQL LNSIEEIRKAIAEKGYRTVGEL YLKDPKYNDHKRNKGYIDGYLS TPNRQMLVDEIKQILDKQRELG NEKLTDEFYATYLLGDENRAGI FQAQRDFDEGPGAGPYAGDQIK KMVGKDIFEPTEDRAAKATYTF QYFNLLQKMTSLNYQNTTGDTW HTLNGLDRQAIIDAVFAKAEKP TKTYKPTDFGELRKLLKLPDDA RFNLVNYGSLQTQKEIETVEKK TRFVDFKAYHDLVKVLPEEMWQ SRQLLDHIGTALTLYSSDKRRR RYFAEELNLPAELIEKLLPLNF SKFGHLSIKSMQNIIPYLEMGQ VYSEATTNTGYDFRKKQISKDT IREEITNPVVRRAVTKTIKIVE QIIRRYGKPDGINIELARELGR NFKERGDIQKRQDKNRQTNDKI AAELTELGIPVNGQNIIRYKLH KEQNGVDPYTGDQIPFERAFSE GYEVDHIIPYSISWDDSYTNKV LTSAKCNREKGNRIPMVYLANN EQRLNALTNIADNIIRNSRKRQ KLLKQKLSDEELKDWKQRNIND TRFITRVLYNYFRQAIEFNPEL EKKQRVLPLNGEVTSKIRSRWG FLKVREDGDLHHAIDATVIAAI TPKFIQQVTKYSQHQEVKNNQA LWHDAEIKDAEYAAEAQRMDAD LFNKIFNGFPLPWPEFLDELLA RISDNPVEMMKSRSWNTYTPIE IAKLKPVFVVRLANHKISGPAH LDTIRSAKLFDEKGIVLSRVSI TKLKINKKGQVATGDGIYDPEN SNNGDKVVYSAIRQALEAHNGS GELAFPDGYLEYVDHGTKKLVR KVRVAKKVSLPVRLKNKAAADN GSMVRIDVFNTGKKFVFVPIYI KDTVEQVLPNKAIARGKSLWYQ ITESDQFCFSLYPGDMVHIESK TGIKPKYSNKENNTSVVPIKNF YGYFDGADIATASILVRAHDSS YTARSIGIAGLLKFEKYQVDYF GRYHKVHEKKRQLFVKRDE (SEQ ID NO: 61) | | | | | | | | | |
| *Elusimicrobium minutum* Pei191 gi\|187250660\| ref\| YP_001875142.1 | MQKNINTKQNHIYIKQAQKIKE KLGDKPYRIGLDLGVGSIGFAI VSMEENDGNVLLPKEIIMVGSR IFKASAGAADRKLSRGQRNNHR HTRERMRYLWKVLAEQKLALPV PADLDRKENSSEGETSAKRFLG DVLQKDIYELRVKSLDERLSLQ ELGYVLYHIAGHRGSSAIRTFE NDSEEAQKENTENKKIAGNIKR LMAKKNYRTYGEYLYKEFFENK EKHKREKISNAANNHKFSPTRD LVIKEAEAILKKQAGKDGFHKE LTEEYIEKLTKAIGYESEKLIP ESGFCPYLKDEKRLPASHKLNE ERRLWETLNNARYSDPIVDIVT GEITGYYEKQFTKEQKQKLFDY LLTGSELTPAQTKKLLGLKNTN FEDIILQGRDKKAQKIKGYKLI KLESMPFWARLSEAQQDSFLYD WNSCPDEKLLTEKLSNEYHLTE EEIDNAFNEIVLSSSYAPLGKS AMLIILEKIKNDLSYTEAVEEA | 177 | 219 | 43 | 322 | 381 | 47 | 322 | 381 | 47 |

TABLE 100-continued

Amino Acid Sequence of Cas9 Orthologs

| Species/ Composite ID | Amino acid sequence | REC2 start (AA pos) | REC2 stop (AA pos) | REC2 # AA deleted (n) | REC1$_{CT}$ start (AA pos) | REC1$_{CT}$ stop (AA pos) | REC1$_{CT}$ # AA deleted (n) | Rec$_{sub}$ start (AA pos) | Rec$_{sub}$ stop (AA pos) | Rec$_{sub}$ # AA deleted (n) |
|---|---|---|---|---|---|---|---|---|---|---|
| | LKEGKLTKEKQAIKDRLPYYGA VLQESTQKIIAKGFSPQFKDKG YKTPHTNKYELEYGRIANPVVH QTLNELRKLVNEIIDILGKKPC EIGLETARELKKSAEDRSKLSR EQNDNESNRNRIYEIYIRPQQQ VIITRRENPRNYILKFELLEEQ KSQCPFCGGQISPNDIINNQAD IEHLFPIAESEDNGRNNLVISH SACNADKAKRSPWAAFASAAKD SKYDYNRILSNVKENIPHKAWR FNQGAFEKFIENKPMAARFKTD NSYISKVAHKYLACLFEKPNII CVKGSLTAQLRMAWGLQGLMIP FAKQLITEKESESFNKDVNSNK KIRLDNRHHALDAIVIAYASRG YGNLLNKMAGKDYKINYSERNW LSKILLPPNNIVWENIDADLES FESSVKTALKNAFISVKHDHSD NGELVKGTMYKIFYSERGYTLT TYKKLSALKLTDPQKKKTPKDF LETALLKFKGRESEMKNEKIKS AIENNKRLFDVIQDNLEKAKKL LEEENEKSKAEGKKEKNINDAS IYQKAISLSGDKYVQLSKKEPG KFFAISKPTPTTTGYGYDTGDS LCVDLYYDNKGKLCGEIIRKID AQQKNPLKYKEQGFTLFERIYG GDILEVDFDIHSDKNSFRNNTG SAPENRVFIKVGTFTEITNNNI QIWFGNIIKSTGGQDDSFTINS MQQYNPRKLILSSCGFIKYRSP ILKNKEG (SEQ ID NO: 62) | | | | | | | | | | |
| *Neisseria meningitidis* Z2491 gi\|218767588\| ref\| YP_002342100.1 | MAAFKPNPINYILGLDIGIASV GWAMVEIDEDENPICLIDLGVR VFERAEVPKTGDSLAMARRLAR SVRRLTRRRAHRLLRARRLLKR EGVLQAADFDENGLIKSLPNTP WQLRAAALDRKLTPLEWSAVLL HLIKHRGYLSQRKNEGETADKE LGALLKGVADNAHALQTGDFRT PAELALNKFEKESGHIRNQRGD YSHTFSRKDLQAELILLFEKQK EFGNPHVSGGLKEGIETLLMTQ RPALSGDAVQKMLGHCTFEPAE PKAAKNTYTAERFIWLTKLNNL RILEQGSERPLTDTERATLMDE PYRKSKLTYAQARKLLGLEDTA FFKGLRYGKDNAEASTLMEMKA YHAISRALEKEGLKDKKSPLNL SPELQDEIGTAFSLFKTDEDIT GRLKDRIQPEILEALLKHISFD KFVQISLKALRRIVPLMEQGKR YDEACAEIYGDHYGKKNTEEKI YLPPIPADEIRNPVVLRALSQA RKVINGVVRRYGSPARIHIETA REVGKSFKDRKEIEKRQEENRK DREKAAAKFREYFPNFVGEPKS KDILKLRLYEQQHGKCLYSGKE INLGRLNEKGYVEIDHALPFSR TWDDSFNNKVLVLGSENQNKGN QTPYEYFNGKDNSREWQEFKAR VETSRFPRSKKQRILLQKFDED GFKERNLNDTRYVNRFLCQFVA DRMRLTGKGKKRVFASNGQITN LLRGFWGLRKVRAENDRHHALD AVVVACSTVAMQQKITRFVRYK EMNAFDGKTIDKETGEVLHQKT HFPQPWEFFAQEVMIRVFGKPD GKPEFEEADTPEKLRTLLAEKL | 147 | 189 | 43 | 360 | 419 | 61 | 360 | 419 | 61 |

TABLE 100-continued

Amino Acid Sequence of Cas9 Orthologs

| Species/ Composite ID | Amino acid sequence | REC2 | | | REC1$_{CT}$ | | | Rec$_{sub}$ | | |
|---|---|---|---|---|---|---|---|---|---|---|
| | | start (AA pos) | stop (AA pos) | # AA deleted (n) | start (AA pos) | stop (AA pos) | # AA deleted (n) | start (AA pos) | stop (AA pos) | # AA deleted (n) |
| | SSRPEAVHEYVTPLFVSRAPNR KMSGQGHMETVKSAKRLDEGVS VLRVPLTQLKLKDLEKMVNRER EPKLYEALKARLEAHKDDPAKA FAEPFYKYDKAGNRTQQVKAVR VEQVQKTGVWVRNHNGIADNAT MVRVDVFEKGDKYYLVPIYSWQ VAKGILPDRAVVQGKDEEDWQL IDDSFNFKFSLHPNDLVEVITK KARMFGYFASCHRGTGNINIRI HDLDHKIGKNGILEGIGVKTAL SFQKYQIDELGKEIRPCRLKKR PPVR (SEQ ID NO: 63) | | | | | | | | | |
| Pasteurella multocida str. Pm70 gi\|15602992\| ref\| NP_246064.1\| | MQTTNLSYILGLDLGIASVGWA VVEINENEDPIGLIDVGVRIFE RAEVPKTGESLALSRRLARSTR RLIRRRAHRLLLAKRFLKREGI LSTIDLEKGLPNQAWELRVAGL ERRLSAIEWGAVLLHLIKHRGY LSKRKNESQTNNKELGALLSGV AQNHQLLQSDDYRTPAELALKK FAKEEGHIRNQRGAYTHTFNRL DLLAELNLLFAQQHQFGNPHCK EHIQQYMTELLMWQKPALSGEA ILKMLGKCTHEKNEFKAAKHTY SAERFVWLTKLNNLRILEDGAE RALNEEERQLLINHPYEKSKLT YAQVRKLLGLSEQAIFKHLRYS KENAESATFMELKAWHAIRKAL ENQGLKDTWQDLAKKPDLLDEI GTAFSLYKTDEDIQQYLTNKVP NSVINALLVSLNFDKFIELSLK SLRKILPLMEQGKRYDQACREI YGHHYGEANQKTSQLLPAIPAQ EIRNPVVLRTLSQARKVINAII RQYGSPARVHIETGRELGKSFK ERREIQKQQEDNRTKRESAVQK FKELFSDFSSEPKSKDILKFRL YEQQHGKCLYSGKEINIHRLNE KGYVEIDHALPFSRTWDDSFNN KVLVLASENQNKGNQTPYEWLQ GKINSERWKNFVALVLGSQCSA AKKQRLLTQVIDDNKFIDRNLN DTRYIARFLSNYIQENLLLVGK NKKNVFTPNGQITALLRSRWGL IKARENNNRHHALDAIVVACAT PSMQQKITRFIRFKEVHPYKIE NRYEMVDQESGEIISPHFPEPW AYFRQEVNIRVFDNHPDTVLKE MLPDRPQANHQFVQPLFVSRAP TRKMSGQGHMETIKSAKRLAEG ISVLRIPLTQLKPNLLENMVNK EREPALYAGLKARLAEFNQDPA KAFATPFYKQGGQQVKAIRVEQ VQKSGVLVRENNGVADNASIVR TDVFIKNNKFFLVPIYTWQVAK GILPNKAIVAHKNEDEWEEMDE GAKFKFSLFPNDLVELKTKKEY FFGYYIGLDRATGNISLKEHDG EISKGKDGVYRVGVKLALSFEK YQVDELGKNRQICRPQQRQPVR (SEQ ID NO: 64) | 139 | 181 | 43 | 319 | 378 | 61 | 319 | 378 | 61 |
| Rhodovulum sp. PH10 gi\|402849997\| ref\| ZP_10898214.1 | MGIRFAFDLGTNSIGWAVWRTG PGVFGEDTAASLDGSGVLIFKD GRNPKDGQSLATMRRVPRQSRK RRDRFVLRRRDLLAALRKAGLF PVDVEEGRRLAATDPYHLRAKA LDESLTPHEMGRVIFHLNQRRG FRSNRKADRQDREKGKIAEGSK RLAETLAATNCRTLGEFLWSRH | 141 | 183 | 43 | 319 | 378 | 48 | 319 | 378 | 48 |

TABLE 100-continued

Amino Acid Sequence of Cas9 Orthologs

| Species/ Composite ID | Amino acid sequence | REC2 start (AA pos) | REC2 stop (AA pos) | REC2 # AA deleted (n) | REC1_CT start (AA pos) | REC1_CT stop (AA pos) | REC1_CT # AA deleted (n) | Rec_sub start (AA pos) | Rec_sub stop (AA pos) | Rec_sub # AA deleted (n) |
|---|---|---|---|---|---|---|---|---|---|---|
| | RGTPRTRSPTRIRMEGEGAKAL YAFYPTREMVRAEFERLWTAQS RFAPDLLTPERHEEIAGILFRQ RDLAPPKIGCCTFEPSERRLPR ALPSVEARGIYERLAHLRITTG PVSDRGLTRPERDVLASALLAG KSLTFKAVRKTLKILPHALVNF EEAGEKGLDGALTAKLLSKPDH YGAAWHGLSFAEKDTFVGKLLD EADEERLIRRLVTENRLSEDAA RRCASIPLADGYGRLGRTANTE ILAALVEETDETGTVVTYAEAV RRAGERTGRNWHHSDERDGVIL DRLPYYGEILQRHVVPGSGEPE EKNEAARWGRLANPTVHIGLNQ LRKVVNRLIAAHGRPDQIVVEL ARELKLNREQKERLDRENRKNR EENERRTAILAEHGQRDTAENK IRLRLFEEQARANAGIALCPYT GRAIGIAELFTSEVEIDHILPV SLTLDDSLANRVLCRREANREK RRQTPFQAFGATPAWNDIVARA AKLPPNKRWRFDPAALERFERE GGFLGRQLNETKYLSRLAKIYL GKICDPDRVYVTPGTLTGLLRA RWGLNSILSDSNFKNRSDHRHH AVDAVVIGVLTRGMIQRIAHDA ARAEDQDLDRVFRDVPVPFEDF RDHVRERVSTITVAVKPEHGKG GALHEDTSYGLVPDTDPNAALG NLVVRKPIRSLTAGEVDRVRDR ALRARLGALAAPFRDESGRVRD AKGLAQALEAFGAENGIRRVRI LKPDASVVTIADRRTGVPYRAV APGENHHVDIVQMRDGSWRGFA ASVFEVNRPGWRPEWEVKKLGG KLVMRLHKGDMVELSDKDGQRR VKVVQQIEISANRVRLSPHNDG GKLQDRHADADDPFRWDLATIP LLKDRGCVAVRVDPIGVVTLRR SNV (SEQ ID NO: 65) | | | | | | | | | |
| Eubacterium dolichum DSM 3991 gi\|160915782\| ref\| ZP_02077990.1 | MMEVFMGRLVLGLDIGITSVGF GIIDLDESEIVDYGVRLFKEGT AAENETRRTKRGGRRLKRRRVT RREDMLHLLKQAGIISTSFHPL NNPYDVRVKGLNERLNGEELAT ALLHLCKHRGSSVETIEDDEAK AKEAGETKKVLSMNDQLLKSGK YVCEIQKERLRTNGHIRGHENN FKTRAYVDEAFQILSHQDLSNE LKSAIITIISRKRMYYDGPGGP LSPTPYGRYTYFGQKEPIDLIE KMRGKCSLFPNEPRAPKLAYSA ELFNLLNDLNNLSIEGEKLTSE QKAMILKIVHEKGKITPKQLAK EVGVSLEQIRGFRIDTKGSPLL SELTGYKMIREVLEKSNDEHLE DHVFYDEIAEILTKTKDIEGRK KQISELSSDLNEESVHQLAGLT KFTAYHSLSFKALRLINEEMLK TELNQMQSITLFGLKQNNELSV KGMKNIQADDTAILSPVAKRAQ RETFKVVNRLREIYGEFDSIVV EMAREKNSEEQRKAIRERQKFF EMRNKQVADIIGDDRKINAKLR EKLVLYQEQDGKTAYSLEPIDL KLLIDDPNAYEVDHIIPISISL DDSITNKVLVTHRENQEKGNLT PISAFVKGRFTKGSLAQYKAYC LKLKEKNIKTNKGYRKKVEQYL LNENDIYKYDIQKEFINRNLVD | 131 | 172 | 42 | 303 | 361 | 59 | 303 | 361 | 59 |

TABLE 100-continued

Amino Acid Sequence of Cas9 Orthologs

| Species/ Composite ID | Amino acid sequence | REC2 start (AA pos) | REC2 stop (AA pos) | REC2 # AA deleted (n) | REC1_CT start (AA pos) | REC1_CT stop (AA pos) | REC1_CT # AA deleted (n) | Rec_sub start (AA pos) | Rec_sub stop (AA pos) | Rec_sub # AA deleted (n) |
|---|---|---|---|---|---|---|---|---|---|---|
| | TSYASRVVLNTLTTYFKQNEIP TKVFTVKGSLTNAFRRKINLKK DRDEDYGHHAIDALIIASMPKM RLLSTIFSRYKIEDIYDESTGE VFSSGDDSMYYDDRYFAFIASL KAIKVRKFSHKIDTKPNRSVAD ETIYSTRVIDGKEKVVKKYKDI YDPKFTALAEDILNNAYQEKYL MALHDPQTFDQIVKVVNYYFEE MSKSEKYFTKDKKGRIKISGMN PLSLYRDEHGMLKKYSKKGDGP AITQMKYFDGVLGNHIDISAHY QVRDKKVVLQQISPYRTDFYYS KENGYKFVTIRYKDVRWSEKKK KYVIDQQDYAMKKAEKKIDDTY EFQFSMHRDELIGITKAEGEAL IYPDETWHNFNFFFHAGETPEI LKFTATNNDKSNKIEVKPIHCY CKMRLMPTISKKIVRIDKYATD VVGNLYKVKKNTLKFEFD (SEQ ID NO: 66) | | | | | | | | | |
| Nitratifractor salsuginis DSM 16511 gi\|319957206\| ref\| YP_004168469.1 | MKKILGVDIGITSFGYAILQET GKDLYRCLDNSVVMRNNPYDEK SGESSQSIRSTQKSMRRLIEKR KKRIRCVAQTMERYGILDYSET MKINDPKNNPIKNRWQLRAVDA WKRPLSPQELFAIFAHMAKHRG YKSIATEDLIYELELELGLNDP EKESEKKADERRQVYNALRHLE ELRKKYGGETIAQTIHRAVEAG DLRSYRNHDDYEKMIRREDIEE EIEKVLLRQAELGALGLPEEQV SELIDELKACITDQEMPTIDES LFGKCTFYKDELAAPAYSYLYD LYRLYKKLADLNIDGYEVTQED REKVIEWVEKKIAQGKNLKKIT HKDLRKILGLAPEQKIFGVEDE RIVKGKKEPRTFVPFFFLADIA KFKELFASIQKHPDALQIFREL AEILQRSKTPQEALDRLRALMA GKGIDTDDRELLELFKNKRSGT RELSHRYILEALPLFLEGYDEK EVQRILGFDDREDYSRYPKSLR HLHLREGNLFEKEENPINNHAV KSLASWALGLIADLSWRYGPFD EIILETTRDALPEKIRKEIDKA MREREKALDKIIGKYKKEFPSI DKRLARKIQLWERQKGLDLYSG KVINLSQLLDGSADIEHIVPQS LGGLSTDYNTIVTLKSVNAAKG NRLPGDWLAGNPDYRERIGMLS EKGLIDWKKRKNLLAQSLDEIY TENTHSKGIRATSYLEALVAQV LKRYYPFPDPELRKNGIGVRMI PGKVTSKTRSLLGIKSKSRETN FHHAEDALILSTLTRGWQNRLH RMLRDNYGKSEAELKELWKKYM PHIEGLTLADYIDEAFRRFMSK GEESLFYRDMFDTIRSISYWVD KKPLSASSHKETVYSSRHEVPT LRKNILEAFDSLNVIKDRHKLT TEEFMKRYDKEIRQKLWLHRIG NTNDESYRAVEERATQIAQILT RYQLMDAQNDKEIDEKFQQALK ELITSPIEVTGKLLRKMRFVYD KLNAMQIDRGLVETDKNMLGIH | 143 | 184 | 42 | 347 | 404 | 61 | 347 | 404 | 61 |

TABLE 100-continued

Amino Acid Sequence of Cas9 Orthologs

| Species/ Composite ID | Amino acid sequence | REC2 start (AA pos) | REC2 stop (AA pos) | REC2 # AA deleted (n) | REC1_CT start (AA pos) | REC1_CT stop (AA pos) | REC1_CT # AA deleted (n) | Rec_sub start (AA pos) | Rec_sub stop (AA pos) | Rec_sub # AA deleted (n) |
|---|---|---|---|---|---|---|---|---|---|---|
| | ISKGPNEKLIFRRMDVNNAHEL QKERSGILCYLNEMLFIFNKKG LIHYGCLRSYLEKGQGSKYIAL FNPRFPANPKAQPSKFTSDSKI KQVGIGSATGIIKAHLDLDGHV RSYEVFGTLPEGSIEWFKEESG YGRVEDDPHH (SEQ ID NO: 67) | | | | | | | | | |
| Rhodospirillum rubrum ATCC 11170 gi\|83591793\|ref\|YP_425545.1\| | MRPIEPWILGLDIGTDSLGWAV FSCEEKGPPTAKELLGGGVRLF DSGRDAKDHTSRQAERGAFRRA RRQTRTWPWRRDRLIALFQAAG LTPPAAETRQIALALRREAVSR PLAPDALWAALLHLAHHRGFRS NRIDKRERAAAKALAKAKPAKA TAKATAPAKEADDEAGFWEGAE AALRQRMAASGAPTVGALLADD LDRGQPVRMRYNQSDRDGVVAP TRALIAEELAEIVARQSSAYPG LDWPAVTRLVLDQRPLRSKGAG PCAFLPGEDRALRALPTVQDFI IRQTLANLRLPSTSADEPRPLT DEEHAKALALLSTARFVEWPAL RRALGLKRGVKFTAETERNGAK QAARGTAGNLTEAILAPLIPGW SGWDLDRKDRVFSDLWAARQDR SALLALIGDPRGPTRVTEDETA EAVADAIQIVLPTGRASLSAKA ARAIAQAMAPGIGYDEAVTLAL GLHHSHRPRQERLARLPYYAAA LPDVGLDGDPVGPPPAEDDGAA AEAYYGRIGNISVHIALNETRK IVNALLHRHGPILRLVMVETTR ELKAGADERKRMIAEQAERERE NAEIDVELRKSDRWMANARERR QRVRLARRQNNLCPYTSTPIGH ADLLGDAYDIDHVIPLARGGRD SLDNMVLCQSDANKTKGDKTPW EAFHDKPGWIAQRDDFLARLDP QTAKALAWRFADDAGERVARKS AEDEDQGFLPRQLTDTGYIARV ALRYLSLVTNEPNAVVATNGRL TGLLRLAWDITPGPAPRDLLPT PRDALRDDTAARRFLDGLTPPP LAKAVEGAVQARLAALGRSRVA DAGLADALGLTLASLGGGGKNR ADHRHHFIDAAMIAVTTRGLIN QINQASGAGRILDLRKWPRTNF EPPYPTFRAEVMKQWDHIHPSI RPAHRDGGSLHAATVFGVRNRP DARVLVQRKPVEKLFLDANAKP LPADKIAEIIDGFASPRMAKRF KALLARYQAAHPEVPPALAALA VARDPAFGPRGMTANTVIAGRS DGDGEDAGLITPFRANPKAAVR TMGNAVYEVWEIQVKGRPRWTH RVLTRFDRTQPAPPPPPENARL VMRLRRGDLVYWPLESGDRLFL VKKMAVDGRLALWPARLATGKA TALYAQLSCPNINLNGDQGYCV QSAEGIRKEKIRTTSCTALGRL RLSKKAT (SEQ ID NO: 68) | 139 | 180 | 42 | 314 | 371 | 55 | 314 | 371 | 55 |
| Clostridium cellulolyticum H10 gi\|220930482\|ref\|YP_002507391.1 | MKYTLGLDVGIASVGWAVIDKD NNKIIDLGVRCFDKAEESKTGE SLATARRIARGMRRRISRRSQR LRLVKKLFVQYEIIKDSSEFNR IFDTSRDGWKDPWELRYNALSR ILKPYELVQVLTHITKRRGFKS NRKEDLSTTKEGVVITSIKNNS | 137 | 176 | 40 | 320 | 376 | 61 | 320 | 376 | 61 |

TABLE 100-continued

Amino Acid Sequence of Cas9 Orthologs

| Species/ Composite ID | Amino acid sequence | REC2 | | | REC1_{CT} | | | Rec_{sub} | | |
|---|---|---|---|---|---|---|---|---|---|---|
| | | start (AA pos) | stop (AA pos) | # AA deleted (n) | start (AA pos) | stop (AA pos) | # AA deleted (n) | start (AA pos) | stop (AA pos) | # AA deleted (n) |
| | EMLRTKNYRTIGEMIFMETPEN SNKRNKVDEYIHTIAREDLLNE IKYIFSIQRKLGSPFVTEKLEH DELNIWEFQRPFASGDSILSKV GKCTLLKEELRAPTSCYTSEYF GLLQSINNLVLVEDNNTLTLNN DQRAKIIEYAHFKNEIKYSEIR KLLDIEPEILFKAHNLTHKNPS GNNESKKFYEMKSYHKLKSTLP TDIWGKLHSNKESLDNLFYCLT VYKNDNEIKDYLQANNLDYLIE YIAKLPTFNKFKHLSLVAMKRI IPFMEKGYKYSDACNMAELDFT GSSKLEKCNKLTVEPIIENVTN PVVIRALTQARKVINAIIQKYG LPYMVNIELAREAGMTRQDRDN LKKEHENNRKAREKISDLIRQN GRVASGLDILKWRLWEDQGGRC AYSGKPIPVCDLLNDSLTQIDH IYPYSRSMDDSYMNKVLVLTDE NQNKRSYTPYEVWGSTEKWEDF EARIYSMHLPQSKEKRLLNRNF ITKDLDSFISRNLNDTRYISRF LKNYIESYLQFSNDSPKSCVVC VNGQCTAQLRSWGLNKNREES DLHHALDAAVIACADRKIIKEI TNYYNERENHNYKVKYPLPWHS FRQDLMETLAGVFISRAPRRKI TGPAHDETIRSPKHFNKGLTSV KIPLTTVTLEKLETMVKNTKGG ISDKAVYNVLKNRLIEHNNKPL KAFAEKIYKPLKNGTNGAIIRS IRVETPSYTGVFRNEGKGISDN SLMVRVDVFKKKDKYYLVPIYV AHMIKKELPSKAIVPLKPESQW ELIDSTHEFLFSLYQNDYLVIK TKKGITEGYYRSCHRGTGSLSL MPHFANNKNVKIDIGVRTAISI EKYNVDILGNKSIVKGEPRRGM EKYNSFKSN (SEQ ID NO: 69) | | | | | | | | | |
| Helicobacter mustelae 12198 gi\|291276265\| ref\| YP_003516037.1 | MIRTLGIDIGIASIGWAVIEGE YTDKGLENKEIVASGVRVFTKA ENPKNKESLALPRTLARSARRR NARKKGRIQQVKHYLSKALGLD LECFVQGEKLATLFQTSKDFLS PWELRERALYRVLDKEELARVI LHIAKRRGYDDITYGVEDNDSG KIKKAIAENSKRIKEEQCKTIG EMMYKLYFQKSLNVRNKKESYN RCVGRSELREELKTIFQIQQEL KSPWVNEELIYKLLGNPDAQSK QEREGLIFYQRPLKGFGDKIGK CSHIKKGENSPYRACKHAPSAE EFVALTKSINFLKNLTNRHGLC FSQEDMCVYLGKILQEAQKNEK GLTYSKLKLLLDLPSDFEFLGL DYSGKNPEKAVFLSLPSTFKLN KITQDRKTQDKIANILGANKDW EAILKELESLQLSKEQIQTIKD AKLNFSKHINLSLEALYHLLPL MREGKRYDEGVEILQERGIFSK PQPKNRQLLPPLSELAKEESYF DIPNPVLRRALSEFRKVVNALL EKYGGFHYFHIELTRDVCKAKS ARMQLEKINKKNKSENDAASQL LEVLGLPNTYNNRLCKLWKQQ EEYCLYSGEKITIDHLKDQRAL QIDHAFPLSRSLDDSQSNKVLC LTSSNQEKSNKTPYEWLGSDEK KWDMYVGRVYSSNFSPSKKRKL | 148 | 187 | 40 | 298 | 354 | 48 | 298 | 354 | 48 |

TABLE 100-continued

Amino Acid Sequence of Cas9 Orthologs

| Species/ Composite ID | Amino acid sequence | REC2 start (AA pos) | REC2 stop (AA pos) | REC2 # AA deleted (n) | REC1$_{CT}$ start (AA pos) | REC1$_{CT}$ stop (AA pos) | REC1$_{CT}$ # AA deleted (n) | Rec$_{sub}$ start (AA pos) | Rec$_{sub}$ stop (AA pos) | Rec$_{sub}$ # AA deleted (n) |
|---|---|---|---|---|---|---|---|---|---|---|
| | TQKNFKERNEEDFLARNLVDTG YIGRVTKEYIKHSLSFLPLPDG KKEHIRIISGSMTSTMRSFWGV QEKNRDHHLHHAQDAIIIACIE PSMIQKYTTYLKDKETHRLKSH QKAQILREGDHKLSLRWPMSNF KDKIQESIQNIIPSHHVSHKVT GELHQETVRTKEFYYQAFGGEE GVKKALKFGKIREINQGIVDNG AMVRVDIFKSKDKGKFYAVPIY TYDFAIGKLPNKAIVQGKKNGI IKDWLEMDENYEFCFSLFKNDC IKIQTKEMQEAVLAIYKSTNSA KATIELEHLSKYALKNEDEEKM FTDTDKEKNKTMTRESCGIQGL KVFQKVKLSVLGEVLEHKPRNR QNIALKTTPKHV (SEQ ID NO: 70) | | | | | | | | | |
| Ilyobacter polytropus DSM 2926 gi\|310780384\| ref\| YP_003968716.1 | MKYSIGLDIGIASVGWSVINKD KERIEDMGVRIFQKAENPKDGS SLASSRREKRGSRRRNRKKHR LDRIKNILCESGLVKKNEIEKI YKNAYLKSPWELRAKSLEAKIS NKEIAQILLHIAKRRGFKSFRK TDRNADDTGKLLSGIQENKKIM EEKGYLTIGDMVAKDPKFNTHV RNKAGSYLFSFSRKLLEDEVRK IQAKQKELGNTHFTDDVLEKYI EVFNSQRNFDEGPSKPSPYYSE IGQIAKMIGNCTFESSEKRTAK NTWSGERFVFLQKLNNFRIVGL SGKRPLTEEERDIVEKEVYLKK EVRYEKLRKILYLKEEERFGDL NYSKDEKQDKKTEKTKFISLIG NYTIKKLNLSEKLKSEIEEDKS KLDKIIEILTFNKSDKTIESNL KKLELSREDIEILLSEEFSGTL NLSLKAIKKILPYLEKGLSYNE ACEKADYDYKNNGIKFKRGELL PVVDKDLIANPVVLRAISQTRK VVNAIIRKYGTPHTIHVEVARD LAKSYDDRQTIIKENKKRELEN EKTKKFISEEFGIKNVKGKLLL KYRLYQEQEGRCAYSRKELSLS EVILDESMTDIDHIIPYSRSMD DSYSNKVLVLSGENRKKSNLLP KEYFDRQGRDWDTFVLNVKAMK IHPRKKSNLLKEKFTREDNKDW KSRALNDTRYISRFVANYLENA LEYRDDSPKKRVFMIPGQLTAQ LRARWRLNKVRENGDLHHALDA AVVAVTDQKAINNISNISRYKE LKNCKDVIPSIEYHADEETGEV YFEEVKDTRFPMPWSGFDLELQ KRLESENPREEFYNLLSDKRYL GWFNYEEGFIEKLRPVFVSRMP NRGVKGQAHQETIRSSKKISNQ IAVSKKPLNSIKLKDLEKMQGR DTDRKLYEALKNRLEEYDDKPE KAFAEPFYKPTNSGKRGPLVRG IKVEEKQNVGVYVNGGQASNGS MVRIDVFRKNGKFYTVPIYVHQ TLLKELPNRAINGKPYKDWDLI DGSFEFLYSFYPNDLIEIEFGK SKSIKNDNKLTKTEIPEVNLSE VLGYYRGMDTSTGAATIDTQDG KIQMRIGIKTVKNIKKYQVDVL GNVYKVKREKRQTF (SEQ ID NO: 71) | 134 | 173 | 40 | 462 | 517 | 63 | 462 | 517 | 63 |

TABLE 100-continued

Amino Acid Sequence of Cas9 Orthologs

| Species/ Composite ID | Amino acid sequence | REC2 | | | REC1$_{CT}$ | | | Rec$_{sub}$ | | |
|---|---|---|---|---|---|---|---|---|---|---|
| | | start (AA pos) | stop (AA pos) | # AA deleted (n) | start (AA pos) | stop (AA pos) | # AA deleted (n) | start (AA pos) | stop (AA pos) | # AA deleted (n) |
| Sphaerochaeta globus str. Buddy gi\|325972003\| ref\| YP_004248194.1 | MSKKVSRRYEEQAQEICQRLGS RPYSIGLDLGVGSIGVAAAYD PIKKQPSDLVFVSSRIFIPSTG AAERRQKRGQRNSLRHRANRLK FLWKLLAERNLMLSYSEQDVPD PARLRFEDAVVRANPYELRLKG LNEQLTLSELGYALYHIANHRG SSSVRTFLDEEKSSDDKKLEEQ QAMTEQLAKEKGISTFIEVLTA FNTNGLIGYRNSESVKSKGVPV PTRDIISNEIDVLLQTQKQFYQ EILSDEYCDRIVSAILFENEKI VPEAGCCPYFPDEKKLPRCHFL NEERRLWEAINNARIKMPMQEG AAKRYQSASFSDEQRHILFHIA RSGTDITPKLVQKEFPALKTSI IVLQGKEKAIQKIAGFRFRRLE EKSFWKRLSEEQKDDFFSAWTN TPDDKRLSKYLMKHLLLTENEV VDALKTVSLIGDYGPIGKTATQ LLMKHLEDGLTYTEALERGMET GEFQELSVWEQQSLLPYYGQIL TGSTQALMGKYWHSAFKEKRDS EGFFKPNTNSDEEKYGRIANPV VHQTLNELRKLMNELITILGAK PQEITVELARELKVGAEKREDI IKQQTKQEKEAVLAYSKYCEPN NLDKRYIERFRLLEDQAFVCPY CLEHISVADIAAGRADVDHIFP RDDTADNSYGNKVVAHRQCNDI KGKRTPYAAFSNTSAWGPIMHY LDETPGMWRKRRKFETNEEEYA KYLQSKGFVSRFESDNSYIAKA AKEYLRCLFNPNNVTAVGSLKG METSILRKAWNLQGIDDLLGSR HWSKDADTSPTMRKNRDDNRHH GLDAIVALYCSRSLVQMINTMS EQGKRAVEIEAMIPIPGYASEP NLSFEAQRELFRKKILEFMDLH AFVSMKTDNDANGALLKDTVYS ILGADTQGEDLVFVVKKKIKDI GVKIGDYEEVASAIRGRITDKQ PKWYPMEMKDKIEQLQSKNEAA LQKYKESLVQAAAVLEESNRKL IESGKKPIQLSEKTISKKALEL VGGYYYLISNNKRTKTFVVKEP SNEVKGFAFDTGSNLCLDFYHD AQGKLCGEIIRKIQAMNPSYKP AYMKQGYSLYVRLYQGDVCELR ASDLTEAESNLAKTTHVRLPNA KPGRTFVIIITFTEMGSGYQIY FSNLAKSKKGQDTSFTLTTIKN YDVRKVQLSSAGLVRYVSPLLV DKIEKDEVALCGE (SEQ ID NO: 72) | 163 | 202 | 40 | 335 | 389 | 45 | 335 | 389 | 45 |
| Staphylococcus lugdunensis M23590 gi\|315659848\| ref\| ZP_07912707.1 | MNQKFILGLDIGITSVGYGLID YETKNIIDAGVRLFPEANVENN EGRRSKRGSRRLKRRRIHRLER VKKLLEDYNLLDQSQIPQSTNP YAIRVKGLSEALSKDELVIALL HIAKRRGIHKIDVIDSNDDVGN ELSTKEQLNKNSKLLKDKFVCQ IQLERMNEGQVRGEKNRFKTAD IIKEIIQLLNVQKNFHQLDENF INKYIELVEMRREYFEGPGKGS PYGWEGDPKAWYETLMGHCTYF PDELRSVKYAYSADLFNALNDL NNLVIQRDGLSKLEYHEKYHII ENVFKQKKKPTLKQIANEINVN PEDIKGYRITKSGKPQFTEFKL YHDLKSVLFDQSILENEDVLDQ | 128 | 167 | 40 | 337 | 391 | 57 | 337 | 391 | 57 |

TABLE 100-continued

Amino Acid Sequence of Cas9 Orthologs

| Species/ Composite ID | Amino acid sequence | REC2 | | | REC1$_{CT}$ | | | Rec$_{sub}$ | | |
|---|---|---|---|---|---|---|---|---|---|---|
| | | start (AA pos) | stop (AA pos) | # AA deleted (n) | start (AA pos) | stop (AA pos) | # AA deleted (n) | start (AA pos) | stop (AA pos) | # AA deleted (n) |
| | IAEILTIYQDKDSIKSKLTELD ILLNEEDKENIAQLTGYTGTHR LSLKCIRLVLEEQWYSSRNQME IFTHLNIKPKKINLTAANKIPK AMIDEFILSPVVKRTFGQAINL INKIIEKYGVPEDIIIELAREN NSKDKQKFINEMQKKNENTRKR INEIIGKYGNQNAKRLVEKIRL HDEQEGKCLYSLESIPLEDLLN NPNHYEVDHIIPRSVSFDNSYH NKVLVKQSENSKKSNLTPYQYF NSGKSKLSYNQFKQHILNLSKS QDRISKKKKEYLLEERDINKFE VQKEFINRNLVDTRYATRELTN YLKAYFSANNMNVKVKTINGSF TDYLRKVWKFKKERNHGYKHHA EDALIIANADFLFKENKKLKAV NSVLEKPEIESKQLDIQVDSED NYSEMFIIPKQVQDIKDERNFK YSHRVDKKPNRQLINDTLYSTR KKDNSTYIVQTIKDIYAKDNTT LKKQFDKSPEKFLMYQHDPRTF EKLEVIMKQYANEKNPLAKYHE ETGEYLTKYSKKNNGPIVKSLK YIGNKLGSHLDVTHQFKSSTKK LVKLSIKPYRFDVYLTDKGYKF ITISYLDVLKKDNYYYIPEQKY DKLKLGKAIDKNAKFIASFYKN DLIKLDGEIYKIIGVNSDTRNM IELDLPDIRYKEYCELNNIKGE PRIKKTIGKKVNSIEKLTTDVL GNVFTNTQYTKPQLLFKRGN (SEQ ID NO: 73) | | | | | | | | | |
| Treponema sp. JC4 gi\|384109266\| ref\| ZP_10010146.1 | MIMKLEKWRLGLDLGTNSIGWS VFSLDKDNSVQDLIDMGVRIFS DGRDPKTKEPLAVARRTARSQR KLIYRRKLRRKQVFKFLQEQGL FPKTKEECMTLKSLNPYELRIK ALDEKLEPYELGRALFNLAVRR GFKSNRKDGSREEVSEKKSPDE IKTQADMQTHLEKAIKENGCRT ITEFLYKNQGENGGIRFAPGRM TYYPTRKMYEEEFNLIRSKQEK YYPQVDWDDIYKAIFYQRPLKP QQRGYCIYENDKERTFKAMPCS QKLRILQDIGNLAYYEGGSKKR VELNDNQDKVLYELLNSKDKVT FDQMRKALCLADSNSFNLEENR DFLIGNPTAVKMRSKNRFGKLW DEIPLEEQDLIIETIITADEDD AVYEVIKKYDLTQEQRDFIVKN TILQSGTSMLCKEVSEKLVKRL EEIADLKYHEAVESLGYKFADQ TVEKYDLLPYYGKVLPGSTMEI DLSAPETNPEKHYGKISNPTVH VALNQTRVVVNALIKEYGKPSQ IAIELSRDLKNNVEKKAEIARK QNQRAKENIAINDTISALYHTA FPGKSFYPNRNDRMKYRLWSEL GLGNKCIYCGKGISGAELFTKE IEIEHILPFSRTLLDAESNLTV AHSSCNAFKAERSPFEAFGTNP SGYSWQEIIQRANQLKNTSKKN KFSPNAMDSFEKDSSFIARQLS DNQYIAKAALRYLKCLVENPSD VWTTNGSMTKLLRDKWEMDSIL CRKFTEKEVALLGLKPEQIGNY KKNRFDHRHHAIDAVVIGLTDR SMVQKLATKNSHKGNRIEIPEF PILRSDLIEKVKNIVVSFKPDH GAEGKLSKETLLGKIKLHGKET | 144 | 183 | 40 | 328 | 382 | 63 | 328 | 382 | 63 |

TABLE 100-continued

Amino Acid Sequence of Cas9 Orthologs

| Species/ Composite ID | Amino acid sequence | REC2 start (AA pos) | REC2 stop (AA pos) | REC2 # AA deleted (n) | REC1_CT start (AA pos) | REC1_CT stop (AA pos) | REC1_CT # AA deleted (n) | Rec_sub start (AA pos) | Rec_sub stop (AA pos) | Rec_sub # AA deleted (n) |
|---|---|---|---|---|---|---|---|---|---|---|
| | FVCRENIVSLSEKNLDDIVDEI KSKVKDYVAKHKGQKIEAVLSD FSKENGIKKVRCVNRVQTPIEI TSGKISRYLSPEDYFAAVIWEI PGEKKTFKAQYIRRNEVEKNSK GLNVVKPAVLENGKPHPAAKQV CLLHKDDYLEFSDKGKMYFCRI AGYAATNNKLDIRPVYAVSYCA DWINSTNETMLTGYWKPTPTQN WVSVNVLFDKQKARLVTVSPIG RVFRK (SEQ ID NO: 74) | | | | | | | | | |
| uncultured delta proteobacterium HF0070007E19 gi\|297182908\| gb\|ADI19058.1\| | MSSKAIDSLEQLDLFKPQEYTL GLDLGIKSIGWAILSGERIANA GVYLFETAEELNSTGNKLISKA AERGRKRRIRRMLDRKARRGRH IRYLLEREGLPTDELEEVVVHQ SNRTLWDVRAEAVERKLTKQEL AAVLFHLVRHRGYFPNTKKLPP DDESDSADEEQGKINRATSRLR EELKASDCKTIGQFLAQNRDRQ RNREGDYSNLMARKLVFEEALQ ILAFQRKQGHELSKDFEKTYLD VLMGQRSGRSPKLGNCSLIPSE LRAPSSAPSTEWFKFLQNLGNL QISNAYREEWSIDAPRRAQIID ACSQRSTSSYWQIRRDFQIPDE YRFNLVNYERRDPDVDLQEYLQ QQERKTLANFRNWKQLEKIIGT GHPIQTLDEAARLITLIKDDEK LSDQLADLLPEASDKAITQLCE LDFTTAAKISLEAMYRILPHMN QGMGFFDACQQESLPEIGVPPA GDRVPPFDEMYNPVVNRVLSQS RKLINAVIDEYGMPAKIRVELA RDLGKGRELRERIKLDQLDKSK QNDQRAEDFRAEFQQAPRGDQS LRYRLWKEQNCTCPYSGRMIPV NSVLSEDTQIDHILPISQSFDN SLSNKVLCFTEENAQKSNRTPF EYLDAADFQRLEAISGNWPEAK RNKLLHKSFGKVAEEWKSRALN DTRYLTSALADHLRHHLPDSKI QTVNGRITGYLRKQWGLEKDRD KHTHHAVDAIVVACTTPAIVQQ VTLYHQDIRRYKKLGEKRPTPW PETFRQDVLDVEEEIFITRQPK KVSGGIQTKDTLRKHRSKPDRQ RVALTKVKLADLERLVEKDASN RNLYEHLKQCLEESGDQPTKAF KAPFYMPSGPEAKQRPILSKVT LLREKPEPPKQLTELSGGRRYD SMAQGRLDIYRYKPGGKRKDEY RVVLQRMIDLMRGEENVHVFQK GVPYDQGPEIEQNYTFLFSLYF DDLVEFQRSADSEVIRGYYRTF NIANGQLKISTYLEGRQDFDFF GANRLAHFAKVQVNLLGKVIK (SEQ ID NO: 75) | 154 | 193 | 40 | 313 | 365 | 55 | 313 | 365 | 55 |
| Alicycliphilus denitrificans K601 gi\|330822845\| ref\| YP_004386148.1 | MRSLRYRLALDLGSTSLGWALF RLDACNRPTAVIKAGVRIFSDG RNPKDGSSLAVTRRAARAMRRR RDRLLKRKTRMQAKLVEHGFFP ADAGKRKALEQLNPYALRAKGL QEALLPGEFARALFHINQRRGF KSNRKTDKKDNDSGVLKKAIGQ LRQQMAEQGSRTVGEYLWTRLQ QGQGVRARYREKPYTTEEGKKR IDKSYDLYIDRAMIEQEFDALW AAQAAFNPTLFHEAARADLKDT LLHQRPLRPVKPGRCTLLPEEE | 140 | 178 | 39 | 317 | 366 | 48 | 317 | 366 | 48 |

TABLE 100-continued

Amino Acid Sequence of Cas9 Orthologs

| Species/ Composite ID | Amino acid sequence | REC2 | | | REC1$_{CT}$ | | | Rec$_{sub}$ | | |
|---|---|---|---|---|---|---|---|---|---|---|
| | | start (AA pos) | stop (AA pos) | # AA deleted (n) | start (AA pos) | stop (AA pos) | # AA deleted (n) | start (AA pos) | stop (AA pos) | # AA deleted (n) |
| | RAPLALPSTQRFRIHQEVNHLR LLDENLREVALTLAQRDAVVTA LETKAKLSFEQIRKLLKLSGSV QFNLEDAKRTELKGNATSAALA RKELFGAAWSGFDEALQDEIVW QLVTEEGEGALIAWLQTHTGVD EARAQAIVDVSLPEGYGNLSRK ALARIVPALRAAVITYDKAVQA AGFDHHSQLGFEYDASEVEDLV HPETGEIRSVFKQLPYYGKALQ RHVAFGSGKPEDPDEKRYGKIA NPTVHIGLNQVRMVVNALIRRY GRPTEVVIELARDLKQSREQKV EAQRRQADNQRRNARIRRSIAE VLGIGEERVRGSDIQKWICWEE LSFDAADRRCPYSGVQISAAML LSDEVEVEHILPFSKTLDDSLN NRTVAMRQANRIKRNRTPWDAR AEFEAQGWSYEDILQRAERMPL RKRYRFAPDGYERWLGDDKDFL ARALNDTRYLSRVAAEYLRLVC PGTRVIPGQLTALLRGKFGLND VLGLDGEKNRNDHRHHAVDACV IGVTDQGLMQRFATASAQARGD GLTRLVDGMPMPWPTYRDHVER AVRHIWVSHRPDHGFEGAMMEE TSYGIRKDGSIKQRRKADGSAG REISNLIRIHEATQPLRHGVSA DGQPLAYKGYVGGSNYCIEITV NDKGKWEGEVISTFRAYGVVRA GGMGRLRNPHEGQNGRKLIMRL VIGDSVRLEVDGAERTMRIVKI SGSNGQIFMAPIHEANVDARNT DKQDAFTYTSKYAGSLQKAKTR RVTISPIGEVRDPGFKG (SEQ ID NO: 76) | | | | | | | | | |
| Azospirillum sp. B510 gi\|288957741\| ref\| YP_003448082.1 | MARPAFRAPRREHVNGWTPDPH RISKPFFILVSWHLLSRVVIDS SSGCFPGTSRDHTDKFAEWECA VQPYRLSFDLGTNSIGWGLLNL DRQGKPREIRALGSRIFSDGRD PQDKASLAVARRLARQMRRRRD RYLTRRTRLMGALVRFGLMPAD PAARKRLEVAVDPYLARERATR ERLEPFEIGRALFHLNQRRGYK PVRTATKPDEEAGKVKEAVERL EAAIAAAGAPTLGAWFAWRKTR GETLRARLAGKGKEAAYPFYPA RRMLEAEFDTLWAEQARHHPDL LTAEAREILRHRIFHQRPLKPP PVGRCTLYPDDGRAPRALPSAQ RLRLFQELASLRVIHLDLSERP LTPAERDRIVAFVQGRPPKAGR KPGKVQKSVPFEKLRGLLELPP GTGFSLESDKRPELLGDETGAR IAPAFGPGWTALPLEEQDALVE LLLTEAEPERAIAALTARWALD EATAAKLAGATLPDFHGRYGRR AVAELLPVLERETRGDPDGRVR PIRLDEAVKLLRGGKDHSDFSR EGALLDALPYYGAVLERHVAFG TGNPADPEEKRVGRVANPTVHI ALNQLRHLVNAILARHGRPEEI VIELARDLKRSAEDRRREDKRQ ADNQKRNEERKRLILSLGERPT PRNLLKLRLWEEQGPVENRRCP YSGETISMRMLLSEQVDIDHIL PFSVSLDDSAANKVVCLREANR IKRNRSPWEAFGHDSERWAGIL ARAEALPKNKRWRFAPDALEKL EGEGGLRARHLNDTRHLSRLAV | 205 | 243 | 39 | 342 | 389 | 46 | 342 | 389 | 46 |

TABLE 100-continued

Amino Acid Sequence of Cas9 Orthologs

| Species/ Composite ID | Amino acid sequence | REC2 start (AA pos) | REC2 stop (AA pos) | REC2 # AA deleted (n) | REC1$_{CT}$ start (AA pos) | REC1$_{CT}$ stop (AA pos) | REC1$_{CT}$ # AA deleted (n) | Rec$_{sub}$ start (AA pos) | Rec$_{sub}$ stop (AA pos) | Rec$_{sub}$ # AA deleted (n) |
|---|---|---|---|---|---|---|---|---|---|---|
| | EYLRCVCPKVRVSPGRLTALLR RRWGIDAILAEADGPPPEVPAE TLDPSPAEKNRADHRHHALDAV VIGCIDRSMVQRVQLAAASAER EAAAREDNIRRVLEGFKEEPWD GFRAELERRARTIVVSHRPEHG IGGALHKETAYGPVDPPEEGFN LVVRKPIDGLSKDEINSVRDPR LRRALIDRLAIRRRDANDPATA LAKAAEDLAAQPASRGIRRVRV LKKESNPIRVEHGGNPSGPRSG GPFHKLLLAGEVHHVDVALRAD GRRWVGHWVTLFEAHGGRGADG AAAPPRLGDGERFLMRLHKGDC LKLEHKGRVRVMQVVKLEPSSN SVVVVEPHQVKTDRSKHVKISC DQLRARGARRVTVDPLGRVRVH APGARVGIGGDAGRTAMEPAED IS (SEQ ID NO: 77) | | | | | | | | | | |
| *Bradyrhizobium sp.* BTAi 1 gi\|148255343\| ref\| YP_001239928.1 | MKRTSLRAYRLGVDLGANSLGW FVVWLDDHGQPEGLGPGGVRIF PDGRNPQSKQSNAAGRRLARSA RRRRDRYLQRRGKLMGLLVKHG LMPADEPARKRLECLDPYGLRA KALDEVLPLHHVGRALFHLNQR RGLFANRAIEQGDKDASAIKAA AGRLQTSMQACGARTLGEFLNR RHQLRATVRARSPVGGDVQARY EFYPTRAMVDAEFEAIWAAQAP HHPTMTAEAHDTIREAIFSQRA MKRPSIGKCSLDPATSQDDVDG FRCAWSHPLAQRFRIWQDVRNL AVVETGPTSSRLGKEDQDKVAR ALLQTDQLSFDEIRGLLGLPSD ARFNLESDRRDHLKGDATGAIL SARRHFGPAWHDRSLDRQIDIV ALLESALDEAAIIASLGTTHSL DEAAAQRALSALLPDGYCRLGL RAIKRVLPLMEAGRTYAEAASA AGYDHALLPGGKLSPTGYLPYY GQWLQNDVVGSDDERDTNERRW GRLPNPTVHIGIGQLRRVVNEL IRWHGPPAEITVELTRDLKLSP RRLAELEREQAENQRKNDKRTS LLRKLGLPASTHNLLKLRLWDE QGDVASECPYTGEAIGLERLVS DDVDIDHLIPFSISWDDSAANK VVCMRYANREKGNRTPFEAFGH RQGRPYDWADIAERAARLPRGK RWRFGPGARAQFEELGDFQARL LNETSWLARVAKQYLAAVTHPH RIHVLPGRLTALLRATWELNDL LPGSDDRAAKSRKDHRHHAIDA LVAALTDQALLRRMANAHDDTR RKIEVLLPWPTFRIDLETRLKA MLVSHKPDHGLQARLHEDTAYG TVEHPETEDGANLVYRKTFVDI SEKEIDRIRDRRLRDLVRAHVA GERQQGKTLKAAVLSFAQRRDI AGHPNGIRHVRLTKSIKPDYLV PIRDKAGRIYKSYNAGENAFVD ILQAESGRWIARATTVFQANQA NESHDAPAAQPIMRVFKGDMLR IDHAGAEKFVKIVRLSPSNNLL YLVEHHQAGVFQTRHDDPEDSF RWLFASFDKLREWNAELVRIDT LGQPWRRKRGLETGSEDATRIG WTRPKKWP (SEQ ID NO: 78) | 143 | 181 | 39 | 323 | 370 | 48 | 323 | 370 | 48 |

TABLE 100-continued

Amino Acid Sequence of Cas9 Orthologs

| Species/ Composite ID | Amino acid sequence | REC2 | | | REC1$_{CT}$ | | | Rec$_{sub}$ | | |
|---|---|---|---|---|---|---|---|---|---|---|
| | | start (AA pos) | stop (AA pos) | # AA deleted (n) | start (AA pos) | stop (AA pos) | # AA deleted (n) | start (AA pos) | stop (AA pos) | # AA deleted (n) |
| *Parvibaculum lavamentivorans* DS-1 gi\|154250555\| ref\| YP_001411379.1 | MERIFGFDIGTTSIGFSVIDYS STQSAGNIQRLGVRIFPEARDP DGTPLNQQRRQKRMMRRQLRRR RIRRKALNETLHEAGFLPAYGS ADWPVVMADEPYELRRRGLEEG LSAYEFGRAIYHLAQHRHFKGR ELEESDTPDPDVDDEKEAANER AATLKALKNEQTTLGAWLARRP PSDRKRGIHAHRNVVAEEFERL WEVQSKFHPALKSEEMRARISD TIFAQRPVFWRKNTLGECRFMP GEPLCPKGSWLSQQRRMLEKLN NLAIAGGNARPLDAEERDAILS KLQQQASMSWPGVRSALKALYK QRGEPGAEKSLKFNLELGGESK LLGNALEAKLADMFGPDWPAHP RKQEIRHAVHERLWAADYGETP DKKRVIILSEKDRKAHREAAAN SFVADFGITGEQAAQLQALKLP TGWEPYSIPALNLFLAELEKGE RFGALVNGPDWEGWRRTNFPHR NQPTGEILDKLPSPASKEERER ISQLRNPTVVRTQNELRKVVNN LIGLYGKPDRIRIEVGRDVGKS KREREEIQSGIRRNEKQRKKAT EDLIKNGIANPSRDDVEKWILW KEGQERCPYTGDQIGFNALFRE GRYEVEHIWPRSRSFDNSPRNK TLCRKDVNIEKGNRMPFEAFGH DEDRWSAIQIRLQGMVSAKGGT GMSPGKVKRFLAKTMPEDFAAR QLNDTRYAAKQILAQLKRLWPD MGPEAPVKVEAVTGQVTAQLRK LWTLNNILADDGEKTRADHRHH AIDALTVACTHPGMTNKLSRYW QLRDDPRAEKPALTPPWDTIRA DAEKAVSEIVVSHRVRKKVSGP LHKETTYGDTGTDIKTKSGTYR QFVTRKKIESLSKGELDEIRDP RIKEIVAAHVAGRGGDPKKAFP PYPCVSPGGPEIRKVRLTSKQQ LNLMAQTGNGYADLGSNHHIAI YRLPDGKADFEIVSLFDASRRL AQRNPIVQRTRADGASFVMSLA AGEAIMIPEGSKKGIWIVQGVW ASGQVVLERDTDADHSTTTRPM PNPILKDDAKKVSIDPIGRVRP SND (SEQ ID NO: 79) | 138 | 176 | 39 | 327 | 374 | 58 | 327 | 374 | 58 |
| *Prevotella timonensis* CRIS 5C-B1 gi\|282880052\| ref\| ZP_06288774.1 | MNKRILGLDTGTNSLGWAVVDW DEHAQSYELIKYGDVIFQEGVK IEKGIESSKAAERSGYKAIRKQ YFRRRLRKIQVLKVLVKYHLCP YLSDDDLRQWHLQKQYPKSDEL MLWQRTSDEEGKNPYYDRHRCL HEKLDLTVEADRYTLGRALYHL TQRRGFLSNRLDTSADNKEDGV VKSGISQLSTEMEEAGCEYLGD YFYKLYDAQGNKVRIRQRYTDR NKHYQHEFDAICEKQELSSELI EDLQRAIFFQLPLKSQRHGVGR CTFERGKPRCADSHPDYEEFRM LCFVNNIQVKGPHDLELRPLTY EEREKIEPLFFRKSKPNFDFED IAKALAGKKNYAWIHDKEERAY KFNYRMTQGVPGCPTIAQLKSI FGDDWKTGIAETYTLIQKKNGS KSLQEMVDDVWNVLYSFSSVEK LKEFAHHKLQLDEESAEKFAKI KLSHSFAALSLKAIRKFLPFLR KGMYYTHASFFANIPTIVGKEI WNKEQNRKYIMENVGELVFNYQ | 170 | 208 | 39 | 328 | 375 | 61 | 328 | 375 | 61 |

TABLE 100-continued

Amino Acid Sequence of Cas9 Orthologs

| Species/ Composite ID | Amino acid sequence | REC2 | | | REC1$_{CT}$ | | | Rec$_{sub}$ | | |
|---|---|---|---|---|---|---|---|---|---|---|
| | | start (AA pos) | stop (AA pos) | # AA deleted (n) | start (AA pos) | stop (AA pos) | # AA deleted (n) | start (AA pos) | stop (AA pos) | # AA deleted (n) |
| | PKHREVQGTIEMLIKDFLANNF ELPAGATDKLYHPSMIETYPNA QRNEFGILQLGSPRTNAIRNPM AMRSLHILRRVVNQLLKESIID ENTEVHVEYARELNDANKRRAI ADRQKEQDKQHKKYGDEIRKLY KEETGKDIEPTQTDVLKFQLWE EQNHHCLYTGEQIGITDFIGSN PKFDIEHTIPQSVGGDSTQMNL TLCDNRFNREVKKAKLPTELAN HEEILTRIEPWKNKYEQLVKER DKQRTFAGMDKAVKDIRIQKRH KLQMEIDYWRGKYERFTMTEVP EGFSRRQGTGIGLISRYAGLYL KSLFHQADSRNKSNVYVVKGVA TAEFRKMWGLQSEYEKKCRDNH SHHCMDAITIACIGKREYDLMA EYYRMEETFKQGRGSKPKFSKP WATFTEDVLNIYKNLLVVHDTP NNMPKHTKKYVQTSIGKVLAQG DTARGSLHLDTYYGAIERDGEI RYVVRRPLSSFTKPEELENIVD ETVKRTIKEAIADKNFKQAIAE PIYMNEEKGILIKKVRCFAKSV KQPINIRQHRDLSKKEYKQQYH VMNENNYLLAIYEGLVKNKVVR EFEIVSYIEAAKYYKRSQDRNI FSSIVPTHSTKYGLPLKTKLLM GQLVLMFEENPDEIQVDNTKDL VKRLYKVVGIEKDGRIKFKYHQ EARKEGLPIFSTPYKNNDDYAP IFRQSINNINILVDGIDFTIDI LGKVTLKE (SEQ ID NO: 80) | | | | | | | | | |
| Bacillus smithii 7347FAA gi\|365156657\| ref\| ZP_09352959.1 | MNYKMGLDIGIASVGWAVINLD LKRIEDLGVRIFDKAEHPQNGE SLALPRRIARSARRRLRRRKHR LERIRRLLVSENVLTKEEMNLL FKQKKQIDVWQLRVDALERKLN NDELARVLLHLAKRRGFKSNRK SERNSKESSEFLKNIEENQSIL AQYRSVGEMIVKDSKFAYHKRN KLDSYSNMIARDDLEREIKLIF EKQREFNNPVCTERLEEKYLNI WSSQRPFASKEDIEKKVGFCTF EPKEKRAPKATYTFQSFIVWEH INKLRLVSPDETRALTEIERNL LYKQAFSKNKMTYYDIRKLLNL SDDIHFKGLLYDPKSSLKQIEN IRFLELDSYHKIRKCIENVYGK DGIRMFNETDIDTFGYALTIFK DDEDIVAYLQNEYITKNGKRVS NLANKVYDKSLIDELLNLSFSK FAHLSMKAIRNILPYMEQGEIY SKACELAGYNFTGPKKKEKALL LPVIPNIANPVVMRALTQSRKV VNAIIKKYGSPVSIHIELARDL SHSFDERKKIQKDQTENRKKNE TAIKQLIEYELTKNPTGLDIVK FKLWSEQQGRCMYSLKPIELER LLEPGYVEVDHILPYSRSLDDS YANKVLVLTKENREKGNHTPVE YLGLGSERWKKFEKFVLANKQF SKKKKQNLLRLRYEETEEKEFK ERNLNDTRYISKFFANFIKEHL KFADGDGGQKVYTINGKITAHL RSRWDFNKNREESDLHHAVDAV IVACATQGMIKKITEFYKAREQ NKESAKKKEPIFPQPWPHFADE LKARLSKFPQESIEAFALGNYD RKKLESLRPVFVSRMPKRSVTG | 134 | 171 | 38 | 401 | 448 | 63 | 401 | 448 | 63 |

TABLE 100-continued

Amino Acid Sequence of Cas9 Orthologs

| Species/ Composite ID | Amino acid sequence | REC2 start (AA pos) | REC2 stop (AA pos) | REC2 # AA deleted (n) | REC1_CT start (AA pos) | REC1_CT stop (AA pos) | REC1_CT # AA deleted (n) | Rec_sub start (AA pos) | Rec_sub stop (AA pos) | Rec_sub # AA deleted (n) |
|---|---|---|---|---|---|---|---|---|---|---|
| | AAHQETLRRCVGIDEQSGKIQT AVKTKLSDIKLDKDGHFPMYQK ESDPRTYEAIRQRLLEHNNDPK KAFQEPLYKPKKNGEPGPVIRT VKIIDTKNKVVHLDGSKTVAYN SNIVRTDVFEKDGKYYCVPVYT MDIMKGTLPNKAIEANKPYSEW KEMTEEYTFQFSLFPNDLVRIV LPREKTIKTSTNEEIIIKDIFA YYKTIDSATGGLELISHDRNFS LRGVGSKTLKRFEKYQVDVLGN IHKVKGEKRVGLAAPTNQKKGK TVDSLQSVSD (SEQ ID NO: 81) | | | | | | | | | |
| Cand. Puniceispirillum marinum IMCC1322 gi\|294086111\| ref\| YP_003552871.1 | MRRLGLDLGTNSIGWCLLDLGD DGEPVSIFRTGARIFSDGRDPK SLGSLKATRREARLTRRRRDRF IQRQKNLINALVKYGLMPADEI QRQALAYKDPYPIRKKALDEAI DPYEMGRAIFHINQRRGFKSNR KSADNEAGVVKQSIADLEMKLG EAGARTIGEFLADRQATNDTVR ARRLSGTNALYEFYPDRYMLEQ EFDTLWAKQAAFNPSLYIEAAR ERLKEIVFFQRKLKPQEVGRCI FLSDEDRISKALPSFQRFRIYQ ELSNLAWIDHDGVAHRITASLA LRDHLFDELEHKKKLTFKAMRA ILRKQGVVDYPVGFNLESDNRD HLIGNLTSCIMRDAKKMIGSAW DRLDEEEQDSFILMLQDDQKGD DEVRSILTQQYGLSDDVAEDCL DVRLPDGHGSLSKKAIDRILPV LRDQGLIYYDAVKEAGLGEANL YDPYAALSDKLDYYGKALAGHV MGASGKFEDSDEKRYGTISNPT VHIALNQVRAVVNELIRLHGKP DEVVIEIGRDLPMGADGKRELE RFQKEGRAKNERARDELKKLGH IDSRESRQKFQLWEQLAKEPVD RCCPFTGKMMSISDLFSDKVEI EHLLPFSLTLDDSMANKTVCFR QANRDKGNRAPFDAFGNSPAGY DWQEILGRSQNLPYAKRWRFLP DAMKRFEADGGFLERQLNDTRY ISRYTTEYISTIIPKNKIWVVT GRLTSLLRGFWGLNSILRGHNT DDGTPAKKSRDDHRHHAIDAIV VGMTSRGLLQKVSKAARRSEDL DLTRLFEGRIDPWDGFRDEVKK HIDAIIVSHRPRKKSQGALHND TAYGIVEHAENGASTVVHRVPI TSLGKQSDIEKVRDPLIKSALL NETAGLSGKSFENAVQKWCADN SIKSLRIVETVSIIPITDKEGV AYKGYKGDGNAYMDIYQDPTSS KWKGEIVSRFDANQKGFIPSWQ SQFPTARLIMRLRINDLLKLQD GEIEEIYRVQRLSGSKILMAPH TEANVDARDRDKNDTFKLTSKS PGKLQSASARKVHISPTGLIRE G (SEQ ID NO: 82) | 135 | 172 | 38 | 344 | 391 | 53 | 344 | 391 | 53 |
| Barnesiella intestinihominis YIT 11860 gi\|404487228\| ref\| ZP_11022414.1 | MKNILGLDLGLSSIGWSVIREN SEEQELVAMGSRVVSLTAAELS SFTQGNGVSINSQRTQKRTQRK GYDRYQLRRTLLRNKLDTLGML PDDSLSYLPKLQLWGLRAKAVT QRIELNELGRVLLHLNQKRGYK SIKSDFSGDKKITDYVKTVKTR YDELKEMRLTIGELFFRRLTEN | 140 | 176 | 37 | 371 | 417 | 60 | 371 | 417 | 60 |

TABLE 100-continued

Amino Acid Sequence of Cas9 Orthologs

| Species/ Composite ID | Amino acid sequence | REC2 start (AA pos) | REC2 stop (AA pos) | REC2 # AA deleted (n) | REC1$_{CT}$ start (AA pos) | REC1$_{CT}$ stop (AA pos) | REC1$_{CT}$ # AA deleted (n) | Rec$_{sub}$ start (AA pos) | Rec$_{sub}$ stop (AA pos) | Rec$_{sub}$ # AA deleted (n) |
|---|---|---|---|---|---|---|---|---|---|---|
| | AFFRCKEQVYPRQAYVEEFDCI MNCQRKFYPDILTDETIRCIRD EIIYYQRPLKSCKYLVSRCEFE KRFYLNAAGKKTEAGPKVSPRT SPLFQVCRLWESINNIVVKDRR NEIVFISAEQRAALFDELNTHE KLKGSDLLKLLGLSKTYGYRLG EQFKTGIQGNKTRVEIERALGN YPDKKRLLQFNLQEESSSMVNT ETGEIIPMISLSFEQEPLYRLW HVLYSIDDREQLQSVLRQKFGI DDDEVLERLSAIDLVKAGFGNK SSKAIRRILPFLQLGMNYAEAC EAAGYNHSNNYTKAENEARALL DRLPAIKKNELRQPVVEKILNQ MVNVVNALMEKYGRFDEIRVEL ARELKQSKEERSNTYKSINKNQ RENEQIAKRIVEYGVPTRSRIQ KYKMWEESKHCCIYCGQPVDVG DFLRGFDVEVEHIIPKSLYFDD SFANKVCSCRSCNKEKNNRTAY DYMKSKGEKALSDYVERVNTMY TNNQISKTKWQNLLTPVDKISI DFIDRQLRESQYIARKAKEILT SICYNVTATSGSVTSFLRHVWG WDTVLHDLNEDRYKKVGLTEVI EVNHRGSVIRREQIKDWSKRED HRHHAIDALTIACTKQAYIQRL NNLRAEEGPDENKMSLERYIQS QPHFSVAQVREAVDRILVSFRA GKRAVTPGKRYIRKNRKRISVQ SVLIPRGALSEESVYGVIHVWE KDEQGHVIQKQRAVMKYPITSI NREMLDKEKVVDKRIHRILSGR LAQYNDNPKEAFAKPVYIDKEC RIPIRTVRCFAKPAINTLVPLK KDDKGNPVAWVNPGNNHHVAIY RDEDGKYKERTVTFWEAVDRCR VGIPAIVTQPDTIWDNILQRND ISENVLESLPDVKWQFVLSLQQ NEMFILGMNEEDYRYAMDQQDY ALLNKYLYRVQKLSKSDYSFRY HTETSVEDKYDGKPNLKLSMQM GKLKRVSIKSLLGLNPHKVHIS VLGEIKEIS (SEQ ID NO: 83) | | | | | | | | | | |
| Ralstonia syzygii R24 gi\|344171927\| emb\|CCA84553.1\| | MAEKQHRWGLDIGTNSIGWAVI ALIEGRPAGLVATGSRIFSDGR NPKDGSSLAVERRGPRQMRRRR DRYLRRRDRFMQALINVGLMPG DAAARKALVTENPYVLRQRGLD QALTLPEFGRALFHLNQRRGFQ SNRKTDRATAKESGKVKNAIAA FRAGMGNARTVGEALARRLEDG RPVRARMVGQGKDEHYELYIAR EWIAQEFDALWASQQRFHAEVL ADAARDRLRAILLFQRKLLPVP VGKCFLEPNQPRVAAALPSAQR FRLMQELNHLRVMTLADKRERP LSFQERNDLLAQLVARPKCGFD MLRKIVFGANKEAYRFTIESER RKELKGCDTAAKLAKVNALGTR WQALSLDEQDRLVCLLLDGEND AVLADALREHYGLTDAQIDTLL GLSFEDGHMRLGRSALLRVLDA LESGRDEQGLPLSYDKAVVAAG YPAHTADLENGERDALPYYGEL LWRYTQDAPTAKNDAERKFGKI ANPTVHIGLNQLRKLVNALIQR YGKPAQIVVELARNLKAGLEEK ERIKKQQTANLERNERIRQKLQ | 140 | 176 | 37 | 395 | 440 | 50 | 395 | 440 | 50 |

TABLE 100-continued

Amino Acid Sequence of Cas9 Orthologs

| | | REC2 | | | REC1$_{CT}$ | | | Rec$_{sub}$ | | |
|---|---|---|---|---|---|---|---|---|---|---|
| Species/ Composite ID | Amino acid sequence | start (AA pos) | stop (AA pos) | # AA deleted (n) | start (AA pos) | stop (AA pos) | # AA deleted (n) | start (AA pos) | stop (AA pos) | # AA deleted (n) |
| | DAGVPDNRENRLRMRLFEELGQ GNGLGTPCIYSGRQISLQRLFS NDVQVDHILPFSKTLDDSFANK VLAQHDANRYKGNRGPFEAFGA NRDGYAWDDIRARAAVLPRNKR NRFAETAMQDWLHNETDELARQ LTDTAYLSRVARQYLTAICSKD DVYVSPGRLTAMLRAKWGLNRV LDGVMEEQGRPAVKNRDDHRHH AIDAVVIGATDRAMLQQVATLA ARAREQDAERLIGDMPTPWPNF LEDVRAAVARCVVSHKPDHGPE GGLHNDTAYGIVAGPFEDGRYR VRHRVSLFDLKPGDLSNVRCDA PLQAELEPIFEQDDARAREVAL TALAERYRQRKVWLEELMSVLP IRPRGEDGKTLPDSAPYKAYKG DSNYCYELFINERGRWDGELIS TFRANQAAYRRFRNDPARFRRY TAGGRPLLMRLCINDYIAVGTA AERTIFRVVKMSENKITLAEHF EGGTLKQRDADKDDPFKYLTKS PGALRDLGARRIFVDLIGRVLD PGIKGD (SEQ ID NO: 84) | | | | | | | | | |
| Wolinella succinogenes DSM 1740 gi\|34557790\| ref\| NP_907605.1\| | MIERILGVDLGISSLGWAIVEY DKDDEAANRIIDCGVRLFTAAE TPKKKESPNKARREARGIRRVL NRRRVRMNMIKKLFLRAGLIQD VDLDGEGGMFYSKANRADVWEL RHDGLYRLLKGDELARVLIHIA KHRGYKFIGDDEADEESGKVKK AGVVLRQNFEAAGCRTVGEWLW RERGANGKKRNKHGDYEISIHR DLLVEEVEAIFVAQQEMRSTIA TDALKAAYREIAFFVRPMQRIE KMVGHCTYFPEERRAPKSAPTA EKFIAISKFFSTVIIDNEGWEQ KIIERKTLEELLDFAVSREKVE FRHLRKFLDLSDNEIFKGLHYK GKPKTAKKREATLFDPNEPTEL EFDKVEAEKKAWISLRGAAKLR EALGNEFYGRFVALGKHADEAT KILTYYKDEGQKRRELTKLPLE AEMVERLVKIGFSDFLKLSLKA IRDILPAMESGARYDEAVLMLG VPHKEKSAILPPLNKTDIDILN PTVIRAFAQFRKVANALVRKYG AFDRVHFELAREINTKGEIEDI KESQRKNEKERKEAADWIAETS FQVPLTRKNILKKRLYIQQDGR CAYTGDVIELERLFDEGYCEID HILPRSRSADDSFANKVLCLAR ANQQKTDRTPYEWFGHDAARWN AFETRTSAPSNRVRTGKGKIDR LLKKNFDENSEMAFKDRNLNDT RYMARAIKTYCEQYWVFKNSHT KAPVQVRSGKLTSVLRYQWGLE SKDRESHTHHAVDAIIIAFSTQ GMVQKLSEYYRFKETHREKERP KLAVPLANFRDAVEEATRIENT ETVKEGVEVKRLLISRPPRARV TGQAHEQTAKPYPRIKQVKNKK KWRLAPIDEEKFESFKADRVAS ANQKNFYETSTIPRVDVYHKKG KFHLVPIYLHEMVLNELPNLSL GTNPEAMDENFFKFSIFKDDLI SIQTQGTPKKPAKIIMGYFKNM | 145 | 180 | 36 | 348 | 392 | 60 | 348 | 392 | 60 |

TABLE 100-continued

Amino Acid Sequence of Cas9 Orthologs

| Species/ Composite ID | Amino acid sequence | REC2 start (AA pos) | REC2 stop (AA pos) | REC2 # AA deleted (n) | REC1$_{CT}$ start (AA pos) | REC1$_{CT}$ stop (AA pos) | REC1$_{CT}$ # AA deleted (n) | Rec$_{sub}$ start (AA pos) | Rec$_{sub}$ stop (AA pos) | Rec$_{sub}$ # AA deleted (n) |
|---|---|---|---|---|---|---|---|---|---|---|
| | HGANMVLSSINNSPCEGFTCTP VSMDKKHKDKCKLCPEENRIAG RCLQGFLDYWSQEGLRPPRKEF ECDQGVKFALDVKKYQIDPLGY YYEVKQEKRLGTIPQMRSAKKL VKK (SEQ ID NO: 86) | | | | | | | | | |
| Mycoplasma gallisepticum str. F gi\|284931710\| gb\|ADC31648.1\| | MNNSIKSKPEVTIGLDLGVGSV GWAIVDNETNIIHHLGSRLFSQ AKTAEDRRSFRGVRRLIRRRKY KLKRFVNLIWKYNSYFGFKNKE DILNNYQEQQKLHNTVLNLKSE ALNAKIDPKALSWILHDYLKNR GHFYEDNRDFNVYPTKELAKYF DKYGYYKGIIDSKEDNDNKLEE ELTKYKFSNKHWLEEVKKVLSN QTGLPEKFKEEYESLFSYVRNY SEGPGSINSVSPYGIYHLDEKE GKVVQKYNNIWDKTIGKCNIFP DEYRAPKNSPIAMIFNEINELS TIRSYSIYLTGWFINQEFKKAY LNKLLDLLIKTNGEKPIDARQF KKLREETIAESIGKETLKDVEN EEKLEKEDHKWKLKGLKLNTNG KIQYNDLSSLAKFVHKLKQHLK LDFLLEDQYATLDKINFLQSLF VYLGKHLRYSNRVDSANLKEFS DSNKLFERILQKQKDGLFKLFE QTDKDDEKILAQTHSLSTKAML LAITRMTNLDNDEDNQKNNDKG WNFEAIKNFDQKFIDITKKNNN LSLKQNKRYLDDRFINDAILSP GVKRILREATKVFNAILKQFSE EYDVTKVVIELARELSEEKELE NTKNYKKLIKKNGDKISEGLKA LGISEDEIKDILKSPTKSYKFL LWLQQDHIDPYSLKEIAFDDIF TKTEKFEIDHIIPYSISFDDSS SNKLLVLAESNQAKSNQTPYEF ISSGNAGIKWEDYEAYCRKFKD GDSSLLDSTQRSKKFAKMMKTD TSSKYDIGFLARNLNDTRYATI VFRDALEDYANNHLVEDKPMFK VVCINGSVTSFLRKNFDDSSYA KKDRDKNIHHAVDASIISIFSN ETKTLFNQLTQFADYKLFKNTD GSWKKIDPKTGVVTEVTDENWK QIRVRNQVSEIAKVIEKYIQDS NIERKARYSRKIENKTNISLFN DTVYSAKKVGYEDQIKRKNLKT LDIHESAKENKNSKVKRQFVYR KLVNVSLLNNDKLADLFAEKED ILMYRANPWVINLAEQIFNEYT ENKKIKSQNVFEKYMLDLTKEF PEKFSEFLVKSMLRNKTAIIYD DKKNIVHRIKRLKMLSSELKEN KLSNVIIRSKNQSGTKLSYQDT INSLALMIMRSIDPTAKKQYIR VPLNTLNLHLGDHDFDLHNMDA YLKKPKFVKYLKANEIGDEYKP WRVLTSGTLLIHKKDKKLMYIS SFQNLNDVIEIKNLIETEYKEN DDDSDSKKKKKANRFLMTLSTIL NDYILLDAKDNFDILGLSKNRI DEILNSKLGLDKIVK (SEQ ID NO: 87) | 144 | 177 | 34 | 373 | 416 | 71 | 373 | 416 | 71 |

TABLE 100-continued

Amino Acid Sequence of Cas9 Orthologs

| | | REC2 | | | REC1$_{CT}$ | | | Rec$_{sub}$ | | |
|---|---|---|---|---|---|---|---|---|---|---|
| Species/ Composite ID | Amino acid sequence | start (AA pos) | stop (AA pos) | # AA deleted (n) | start (AA pos) | stop (AA pos) | # AA deleted (n) | start (AA pos) | stop (AA pos) | # AA deleted (n) |
| *Acidothermus cellulolyticus* 11B gi\|117929158\| ref\| YP_873709.1\| | MGGSEVGTVPVTWRLGVDVGER SIGLAAVSYEEDKPKEILAAVS WIHDGGVGDERSGASRLALRGM ARRARRLRRFRRARLRDLDMLL SELGWTPLPDKNVSPVDAWLAR KRLAEEYVVDETERRRLLGYAV SHMARHRGWRNPWTTIKDLKNL PQPSDSWERTRESLEARYSVSL EPGTVGQWAGYLLQRAPGIRLN PTQQSAGRRAELSNATAFETRL RQEDVLWELRCIADVQGLPEDV VSNVIDAVFCQKRPSVPAERIG RDPLDPSQLRASRACLEFQEYR IVAAVANLRIRDGSGSRPLSLE ERNAVIEALLAQTERSLTWSDI ALEILKLPNESDLTSVPEEDGP SSLAYSQFAPFDETSARIAEFI AKNRRKIPTFAQWWQEQDRTSR SDLVAALADNSIAGEEEQELLV HLPDAELEALEGLALPSGRVAY SRLTLSGLTRVMRDDGVDVHNA RKTCFGVDDNWRPPLPALHEAT GHPVVDRNLAILRKFLSSATMR WGPPQSIVVELARGASESRERQ AEEEAARRAHRKANDRIRAELR ASGLSDPSPADLVRARLLELYD CHCMYCGAPISWENSELDHIVP RTDGGSNRHENLAITCGACNKE KGRRPFASWAETSNRVQLRDVI DRVQKLKYSGNMYWTRDEFSRY KKSVVARLKRRTSDPEVIQSIE STGYAAVALRDRLLSYGEKNGV AQVAVFRGGVTAEARRWLDISI ERLFSRVAIFAQSTSTKRLDRR HHAVDAVVLTTLTPGVAKTLAD ARSRRVSAEFWRRPSDVNRHST EEPQSPAYRQWKESCSGLGDLL ISTAARDSIAVAAPLRLRPTGA LHEETLRAFSEHTVGAAWKGAE LRRIVEPEVYAAFLALTDPGGR FLKVSPSEDVLPADENRHIVLS DRVLGPRDRVKLFPDDRGSIRV RGGAAYIASFHHARVFRWGSSH SPSFALLRVSLADLAVAGLLRD GVDVFTAELPPWTPAWRYASIA LVKAVESGDAKQVGWLVPGDEL DFGPEGVTTAAGDLSMFLKYFP ERHWVVTGFEDDKRINLKPAFL SAEQAEVLRTERSDRPDTLTEA GEILAQFFPRCWRATVAKVLCH PGLTVIRRTALGQPRWRRGHLP YSWRPWSADPWSGGTP (SEQ ID NO: 88) | 150 | 182 | 33 | 341 | 380 | 58 | 341 | 380 | 58 |
| *Mycoplasma ovipneumoniae* SC01 gi\|363542550\| ref\| ZP_09312133.1 | MHNKKNITIGFDLGIASIGWAI IDSTTSKILDWGTRTFEERKTA NERRAFRSTRRNIRRKAYRNQR FINLILKYKDLFELKNISDIQR ANKKDTENYEKIISFFTEIYKK CAAKHSNILEVKVKALDSKIEK LDLIWILHDYLENRGFFYDLEE ENVADKYEGIEHPSILLYDFFK KNGFFKSNSSIPKDLGGYSFSN LQWVNEIKKLFEVQEINPEFSE KFLNLFTSVRDYAKGPGSEHSA SEYGIFQKDEKGKVFKKYDNIW DKTIGKCSFFVEENRSPVNYPS YEIFNLLNQLINLSTDLKTTNK KIWQLSSNDRNELLDELLKVKE KAKIISISLKKNEIKKIILKDF GFEKSDIDDQDTIEGRKIIKEE PTTKLEVTKHLLATIYSHSSDS | 156 | 184 | 29 | 381 | 420 | 62 | 381 | 420 | 62 |

TABLE 100-continued

Amino Acid Sequence of Cas9 Orthologs

| Species/Composite ID | Amino acid sequence | REC2 start (AA pos) | REC2 stop (AA pos) | REC2 # AA deleted (n) | REC1$_{CT}$ start (AA pos) | REC1$_{CT}$ stop (AA pos) | REC1$_{CT}$ # AA deleted (n) | Rec$_{sub}$ start (AA pos) | Rec$_{sub}$ stop (AA pos) | Rec$_{sub}$ # AA deleted (n) |
|---|---|---|---|---|---|---|---|---|---|---|
| | NWININNILEFLPYLDAICIIL DREKSRGQDEVLKKLTEKNIFE VLKIDREKQLDFVKSIFSNTKF NFKKIGNFSLKAIREFLPKMFE QNKNSEYLKWKDEEIRRKWEEQ KSKLGKTDKKTKYLNPRIFQDE IISPGTKNTFEQAVLVLNQIIK KYSKENIIDAIIIESPREKNDK KTIEEIKKRNKKGKGKTLEKLF QILNLENKGYKLSDLETKPAKL LDRLRFYHQQDGIDLYTLDKIN IDQLINGSQKYEIEHIIPYSMS YDNSQANKILTEKAENLKKGKL IASEYIKRNGDEFYNKYYEKAK ELFINKYKKNKKLDSYVDLDED SAKNRFRFLTLQDYDEFQVEFL ARNLNDTRYSTKLFYHALVEHF ENNEFFTYIDENSSKHKVKIST IKGHVTKYFRAKPVQKNNGPNE NLNNNKPEKIEKNRENNEHHAV DAAIVAIIGNKNPQIANLLTLA DNKTDKKFLLHDENYKENIETG ELVKIPKFEVDKLAKVEDLKKI IQEKYEEAKKHTAIKFSRKTRT ILNGGLSDETLYGFKYDEKEDK YFKIIKKKLVTSKNEELKKYFE NPFGKKADGKSEYTVLMAQSHL SEFNKLKEIFEKYNGFSNKTGN AFVEYMNDLALKEPTLKAEIES AKSVEKLLYYNFKPSDQFTYHD NINNKSFKRFYKNIRIIEYKSI PIKFKILSKHDGGKSFKDTLFS LYSLVYKVYENGKESYKSIPVT SQMRNFGIDEFDFLDENLYNKE KLDIYKSDFAKPIPVNCKPVFV LKKGSILKKKSLDIDDFKETKE TEEGNYYFISTISKRENRDTAY GLKPLKLSVVKPVAEPSTNPIF KEYIPIHLDELGNEYPVKIKEH TDDEKLMCTIK (SEQ ID NO: 89) | | | | | | | | | | |

If any of the above Cas9 sequences are fused with a peptide or polypeptide at the C-terminus, it is understood that the stop codon will be removed.

Exemplary PAM sequences and their corresponding RKR motifs are provided in Table 250.

TABLE 250

Identified PAM sequences and corresponding RKR motifs.

| Strain Name | PAM sequence (NA) | RKR motif (AA) |
|---|---|---|
| *Streptococcus pyogenes* | NGG | RKR |
| *Streptococcus mutans* | NGG | RKR |
| *Streptococcus thermophilus* | ANGGNG (SEQ ID NO: 122) | RYR |
| *Treponema denticola* | NAAAAN (SEQ ID NO: 134) | VAK |
| *Streptococcus thermophilus* | BNNAAAAW (SEQ ID NO: 135) | IYK |
| *Campylobacter jejuni* | NNNNACA (SEQ ID NO: 136) | NLK |

TABLE 250-continued

Identified PAM sequences and corresponding RKR motifs.

| Strain Name | PAM sequence (NA) | RKR motif (AA) |
|---|---|---|
| Pasteurella multocida | GNNNCNNA (SEQ ID NO: 137) | KDG |
| Neisseria meningitidis | NNNNGATT (SEQ ID NO: 106) NNGRRT (SEQ ID NO: 104) (R = A or G) | or IGK |
| Staphylococcus aureus | NNGRR (R = A or G) (SEQ ID NO: 125) | NDK |

Exemplary Cas9 core domains are provided in Table 200.

TABLE 200

Amino Acid Sequence of Cas9 Core Domains

| Strain Name | Cas9 Start (AA pos) | Cas9 Stop (AA pos) |
|---|---|---|
| | Start and Stop numbers refer to the sequence in Table 100 | |
| Staphylococcus aureus | 1 | 772 |
| Streptococcus pyogenes | 1 | 1099 |
| Campulobacter jejuni | 1 | 741 |

Exemplary PI domains, e.g., altered PI domains, are provided in Tables 400 and 500.

TABLE 400

Altered PI Domain

| Strain Name | PI Start (AA pos) | PI Stop (AA pos) | Length of PI (AA) | RKR motif (AA) |
|---|---|---|---|---|
| Alicycliphilus denitrificans K601 | 837 | 1029 | 193 | --Y |
| | Start and Stop numbers refer to the sequences in Table 100 | | | |
| Campylobacter jejuni NCTC 11168 | 741 | 984 | 244 | -NG |
| Helicobacter mustelae 12198 | 771 | 1024 | 254 | -NQ |

TABLE 500

Other Altered PI Domains

| Strain Name | PI Start (AA pos) | PI Stop (AA pos) | Length of PI (AA) | RKR motif (AA) |
|---|---|---|---|---|
| | Start and Stop numbers refer to the sequences in Table 100 | | | |
| Akkermansia muciniphila ATCC BAA-835 | 871 | 1101 | 231 | ALK |
| Ralstonia syzygii R24 | 821 | 1062 | 242 | APY |
| Cand. Puniceispirillum marinum IMCC1322 | 815 | 1035 | 221 | AYK |
| Fructobacillus fructosus KCTC 3544 | 1074 | 1323 | 250 | DGN |
| Eubacterium yurii ATCC 43715 | 1107 | 1391 | 285 | DGY |
| Eubacterium dolichum DSM 3991 | 779 | 1096 | 318 | DKK |
| Dinoroseobacters hibae DFL 12 | 851 | 1079 | 229 | DPI |
| Clostridium cellulolyticum H10 | 767 | 1021 | 255 | EGK |
| Pasteurella multocida str. Pm 70 | 815 | 1056 | 242 | ENN |
| Mycoplasma canis PG 14 | 907 | 1233 | 327 | EPK |
| Porphyromonas sp. oral taxon 279 s tr. F0450 | 935 | 1197 | 263 | EPT |
| Filifactor alocis ATCC 35896 | 1094 | 1365 | 272 | EVD |
| Aminomonas paucivorans DSM 12260 | 801 | 1052 | 252 | EVY |
| Wolinella succinogenes DSM 1740 | 1034 | 1409 | 376 | EYK |
| Oenococcus kitaharae DSM 17330 | 1119 | 1389 | 271 | GAL |
| Coriobacterium glomerans PW2 | 1126 | 1384 | 259 | GDR |
| Peptoniphilus duerdenii ATCC BAA-1640 | 1091 | 1364 | 274 | GDS |
| Bifidobacterium bifidum S17 | 1138 | 1420 | 283 | GGL |
| Alicyclobacillus hesperidum URH17-3-68 | 876 | 1146 | 271 | GGR |
| Rose buria inulinivorans DSM 16841 | 895 | 1152 | 258 | GGT |
| Actinomyces coleocanis DSM 15436 | 843 | 1105 | 263 | GKK |
| Odori bacter laneus YIT 12061 | 1103 | 1498 | 396 | GKV |
| Coprococcus catus GD-7 | 1063 | 1338 | 276 | GNQ |
| Enterococcus faecalis TX0012 | 829 | 1150 | 322 | GRK |
| Bacillus smithii 7 3 47FAA | 809 | 1088 | 280 | GSK |
| Legionella pneumophila str. Paris | 1021 | 1372 | 352 | GTM |
| Bacteroides fragilis NCTC 9343 | 1140 | 1436 | 297 | IPV |
| Mycoplasma ovipneumoniae SC01 | 923 | 1265 | 343 | IRI |
| Actinomyces sp. oral taxon 180 s tr. F0310 | 895 | 1181 | 287 | KEK |
| Treponema sp. JC4 | 832 | 1062 | 231 | KIS |
| Fusobacterium nucleatum ATCC49256 | 1073 | 1374 | 302 | KKV |
| Lactobacillus farciminis KCTC 3681 | 1101 | 1356 | 256 | KKV |

TABLE 500-continued

Other Altered PI Domains

| Strain Name | PI Start (AA pos) | PI Stop (AA pos) | Length of PI (AA) | RKR motif (AA) |
|---|---|---|---|---|
| *Nitratifractors alsuginis* DSM 16511 | 840 | 1132 | 293 | KMR |
| *Lactobacillus coryniformis* KCTC 3535 | 850 | 1119 | 270 | KNK |
| *Mycoplasma mobile* 163K | 916 | 1236 | 321 | KNY |
| *Flavobacterium branchiophilum* FL-15 | 1182 | 1473 | 292 | KQK |
| *Prevotellatimonensis* CRIS 5C-B1 | 957 | 1218 | 262 | KQQ |
| *Methylosinus trichosporium* OB3b | 830 | 1082 | 253 | KRP |
| *Prevotella* sp. C561 | 1099 | 1424 | 326 | KRY |
| *Mycoplasma gallisepticum* str. F | 911 | 1269 | 359 | KTA |
| *Lactobacillus rhamnosus* GG | 1077 | 1363 | 287 | KYG |
| *Wolinella succinogenes* DSM 1740 | 811 | 1059 | 249 | LPN |
| *Streptococcus thermophilus* LMD-9 | 1099 | 1388 | 290 | MLA |
| *Treponema denticola* ATCC 35405 | 1092 | 1395 | 304 | NDS |
| *Bergeyella zoohelcum* ATCC 43767 | 1098 | 1415 | 318 | NEK |
| *Veillonella atypica* ACS-134-V-Col7a | 1107 | 1398 | 292 | NGF |
| *Neisseria meningitidis* Z2491 | 835 | 1082 | 248 | NHN |
| *Ignavibacterium album* JCM 16511 | 1296 | 1688 | 393 | NKK |
| *Ruminococcus albus* 8 | 853 | 1156 | 304 | NNF |
| *Streptococcus thermophilus* LMD-9 | 811 | 1121 | 311 | NNK |
| *Barnesiella intestinihominis* YIT 11860 | 871 | 1153 | 283 | NPV |
| *Azos pirillums* p. B510 | 911 | 1168 | 258 | PFH |
| *Rhodospirillum rubrum* ATCC 11170 | 863 | 1173 | 311 | PRG |
| *Planococcus antarcticus* DSM 14505 | 1087 | 1333 | 247 | PYY |
| *Staphylococcus pseudintermedius* ED99 | 1073 | 1334 | 262 | QIV |
| *Alca nivorax* sp. W11-5 | 843 | 1113 | 271 | RIE |
| *Bradyrhizobium* sp. BTAi1 | 811 | 1064 | 254 | RIY |
| *Streptococcus pyogenes* M1 GAS | 1099 | 1368 | 270 | RKR |
| *Streptococcus mutans* UA159 | 1078 | 1345 | 268 | RKR |
| *Streptococcus pyogenes* | 1099 | 1368 | 270 | RKR |
| *Bacteroides* sp. 20 3 | 1147 | 1517 | 371 | RNI |
| *S. aureus* | 772 | 1053 | 282 | RNK |
| *Solobacterium moorei* F0204 | 1062 | 1327 | 266 | RSG |
| *Finegoldia magna* ATCC 29328 | 1081 | 1348 | 268 | RTE |
| uncultured delta proteobacterium HF0070 07E19 | 770 | 1011 | 242 | SGG |
| *Acida minococcus* sp. D21 | 1064 | 1358 | 295 | SIG |
| *Eubacterium rectale* ATCC 33656 | 824 | 1114 | 291 | SKK |
| *Caenispirillum salinarum* AK4 | 1048 | 1442 | 395 | SLV |
| *Acidothermus cellulolyticus* 11B | 830 | 1138 | 309 | SPS |
| *Catenibacterium mitsuokai* DSM 15897 | 1068 | 1329 | 262 | SPT |
| *Parvibaculum lavamentivorans* DS-1 | 827 | 1037 | 211 | TGN |
| *Staphylococcus lugdunensis* M23590 | 772 | 1054 | 283 | TKK |
| *Streptococcus sanguinis* SK49 | 1123 | 1421 | 299 | TRM |
| *Elusimicrobium minutum* Pei191 | 910 | 1195 | 286 | TTG |
| *Nitrobacter hamburgensis* X14 | 914 | 1166 | 253 | VAY |
| *Mycoplasma synoviae* 53 | 991 | 1314 | 324 | VGF |
| *Sphaerochaeta globus* str. Buddy | 877 | 1179 | 303 | VKG |
| *Ilyobacter polytropus* DSM 2926 | 837 | 1092 | 256 | VNG |
| *Rhodovulum* sp. PH10 | 821 | 1059 | 239 | VPY |
| *Bifidobacterium longum* DJO10A | 904 | 1187 | 284 | VRK |

Nucleic Acids Encoding Cas9 Fusion Molecules

Nucleic acids encoding the Cas9 fusion molecules, the Cas9 molecules or Cas9 polypeptides, e.g., an eaCas9 molecule or eaCas9 polypeptides, are provided herein.

In an embodiment, a nucleic acid encoding a Cas9 fusion molecule, a Cas9 molecule, or Cas9 polypeptide, can be a synthetic nucleic acid sequence. For example, the synthetic nucleic acid molecule can be chemically modified, e.g., as described in Section XI. In an embodiment, the mRNA, e.g., coding for a Cas9 fusion molecule, Cas9 molecule, or Cas9 polypeptide, disclosed herein, has one or more, e.g., all, of the following properties: it is capped, polyadenylated, substituted with 5-methylcytidine and/or pseudouridine.

In addition, or alternatively, the synthetic nucleic acid sequence can be codon optimized, e.g., at least one non-common codon or less-common codon has been replaced by a codon that is common in the host cell. For example, the synthetic nucleic acid can direct the synthesis of an optimized messenger mRNA, e.g., optimized for expression in a mammalian expression system, e.g., described herein.

In addition, or alternatively, a nucleic acid encoding a Cas9 fusion molecule, a Cas9 molecule, or a Cas9 polypeptide, may comprise a nuclear localization sequence (NLS). Nuclear localization sequences are known in the art.

Provided below is an exemplary codon optimized nucleic acid sequence encoding a Cas9 molecule of *S. pyogenes*.

```
                                    (SEQ ID NO: 138)
ATGGATAAAA AGTACAGCAT CGGGCTGGAC ATCGGTACAA

ACTCAGTGGG GTGGGCCGTG ATTACGGACG AGTACAAGGT

ACCCTCCAAA AAATTTAAAG TGCTGGGTAA CACGGACAGA

CACTCTATAA AGAAAAATCT TATTGGAGCC TTGCTGTTCG

ACTCAGGCGA GACAGCCGAA GCCACAAGGT TGAAGCGGAC

CGCCAGGAGG CGGTATACCA GGAGAAAGAA CCGCATATGC

TACCTGCAAG AAATCTTCAG TAACGAGATG GCAAAGGTTG
```

```
ACGATAGCTT TTTCCATCGC CTGGAAGAAT CCTTTCTTGT
TGAGGAAGAC AAGAAGCACG AACGGCACCC CATCTTTGGC
AATATTGTCG ACGAAGTGGC ATATCACGAA AAGTACCCGA
CTATCTACCA CCTCAGGAAG AAGCTGGTGG ACTCTACCGA
TAAGGCGGAC CTCAGACTTA TTTATTTGGC ACTCGCCCAC
ATGATTAAAT TTAGAGGACA TTTCTTGATC GAGGGCGACC
TGAACCCGGA CAACAGTGAC GTCGATAAGC TGTTCATCCA
ACTTGTGCAG ACCTACAATC AACTGTTCGA AGAAACCCT
ATAAATGCTT CAGGAGTCGA CGCTAAAGCA ATCCTGTCCG
CGCGCCTCTC AAAATCTAGA AGACTTGAGA ATCTGATTGC
TCAGTTGCCC GGGGAAAAGA AAAATGGATT GTTTGGCAAC
CTGATCGCCC TCAGTCTCGG ACTGACCCCA AATTTCAAAA
GTAACTTCGA CCTGGCCGAA GACGCTAAGC TCCAGCTGTC
CAAGGACACA TACGATGACG ACCTCGACAA TCTGCTGGCC
CAGATTGGGG ATCAGTACGC CGATCTCTTT TTGGCAGCAA
AGAACCTGTC CGACGCCATC CTGTTGAGCG ATATCTTGAG
AGTGAACACC GAAATTACTA AGCACCCCT TAGCGCATCT
ATGATCAAGC GGTACGACGA GCATCATCAG GATCTGACCC
TGCTGAAGGC TCTTGTGAGG CAACAGCTCC CCGAAAAATA
CAAGGAAATC TTCTTTGACC AGAGCAAAAA CGGCTACGCT
GGCTATATAG ATGGTGGGGC CAGTCAGGAG GAATTCTATA
AATTCATCAA GCCCATTCTC GAGAAAATGG ACGGCACAGA
GGAGTTGCTG GTCAAACTTA ACAGGGAGGA CCTGCTGCGG
AAGCAGCGGA CCTTTGACAA CGGGTCTATC CCCCACCAGA
TTCATCTGGG CGAACTGCAC GCAATCCTGA GGAGGCAGGA
GGATTTTTAT CCTTTTCTTA AGATAACCG CGAGAAAATA
GAAAAGATTC TTACATTCAG GATCCCGTAC TACGTGGGAC
CTCTCGCCCG GGGCAATTCA CGGTTTGCCT GGATGACAAG
GAAGTCAGAG GAGACTATTA CACCTTGGAA CTTCGAAGAA
GTGGTGGACA AGGGTGCATC TGCCCAGTCT TTCATCGAGC
GGATGACAAA TTTTGACAAG AACCTCCCTA ATGAGAAGGT
GCTGCCCAAA CATTCTCTGC TCTACGAGTA CTTTACCGTC
TACAATGAAC TGACTAAAGT CAAGTACGTC ACCGAGGGAA
TGAGGAAGCC GGCATTCCTT AGTGGAGAAC AGAAGAAGGC
GATTGTAGAC CTGTTGTTCA AGACCAACAG GAAGGTGACT
GTGAAGCAAC TTAAAGAAGA CTACTTTAAG AAGATCGAAT
GTTTTGACAG TGTGGAAATT TCAGGGGTTG AAGACCGCTT
CAATGCGTCA TTGGGGACTT ACCATGATCT TCTCAAGATC
ATAAAGGACA AAGACTTCCT GGACAACGAA GAAAATGAGG
ATATTCTCGA AGACATCGTC CTCACCCTGA CCCTGTTCGA

AGACAGGGAA ATGATAGAAG AGCGCTTGAA AACCTATGCC
CACCTCTTCG ACGATAAAGT TATGAAGCAG CTGAAGCGCA
GGAGATACAC AGGATGGGGA AGATTGTCAA GGAAGCTGAT
CAATGGAATT AGGGATAAAC AGAGTGGCAA GACCATACTG
GATTTCCTCA AATCTGATGG CTTCGCCAAT AGGAACTTCA
TGCAACTGAT TCACGATGAC TCTCTTACCT TCAAGGAGGA
CATTCAAAAG GCTCAGGTGA GCGGGCAGGG AGACTCCCTT
CATGAACACA TCGCGAATTT GGCAGGTTCC CCCGCTATTA
AAAAGGGCAT CCTTCAAACT GTCAAGGTGG TGGATGAATT
GGTCAAGGTA ATGGGCAGAC ATAAGCCAGA AAATATTGTG
ATCGAGATGG CCCGCGAAAA CCAGACCACA CAGAAGGGCC
AGAAAATAG TAGAGAGCGG ATGAAGAGGA TCGAGGAGGG
CATCAAAGAG CTGGGATCTC AGATTCTCAA AGAACACCCC
GTAGAAAACA CACAGCTGCA GAACGAAAAA TTGTACTTGT
ACTATCTGCA GAACGGCAGA GACATGTACG TCGACCAAGA
ACTTGATATT AATAGACTGT CCGACTATGA CGTAGACCAT
ATCGTGCCCC AGTCCTTCCT GAAGGACGAC TCCATTGATA
ACAAAGTCTT GACAAGAAGC GACAAGAACA GGGGTAAAAG
TGATAATGTG CCTAGCGAGG AGGTGGTGAA AAAAATGAAG
AACTACTGGC GACAGCTGCT TAATGCAAAG CTCATTACAC
AACGGAAGTT CGATAATCTG ACGAAAGCAG AGAGAGGTGG
CTTGTCTGAG TTGGACAAGG CAGGGTTTAT TAAGCGGCAG
CTGGTGGAAA CTAGGCAGAT CACAAAGCAC GTGGCGCAGA
TTTTGGACAG CCGGATGAAC ACAAAATACG ACGAAAATGA
TAAACTGATA CGAGAGGTCA AAGTTATCAC GCTGAAAAGC
AAGCTGGTGT CCGATTTTCG GAAAGACTTC CAGTTCTACA
AAGTTCGCGA GATTAATAAC TACCATCATG CTCACGATGC
GTACCTGAAC GCTGTTGTCG GGACCGCCTT GATAAAGAAG
TACCCAAAGC TGGAATCCGA GTTCGTATAC GGGGATTACA
AAGTGTACGA TGTGAGGAAA ATGATAGCCA AGTCCGAGCA
GGAGATTGGA AAGGCCACAG CTAAGTACTT CTTTTATTCT
AACATCATGA ATTTTTTAA GACGGAAATT ACCCTGGCCA
ACGGAGAGAT CAGAAAGCGG CCCCTTATAG AGACAAATGG
TGAAACAGGT GAAATCGTCT GGGATAAGGG CAGGGATTTC
GCTACTGTGA GGAAGGTGCT GAGTATGCCA CAGGTAAATA
TCGTGAAAAA AACCGAAGTA CAGACCGGAG GATTTTCCAA
GGAAAGCATT TTGCCTAAAA GAAACTCAGA CAAGCTCATC
GCCCGCAAGA AGATTGGGAC CCTAAGAAA TACGGGGGAT
TTGACTCACC CACCGTAGCC TATTCTGTGC TGGTGGTAGC
TAAGGTGGAA AAAGGAAAGT CTAAGAAGCT GAAGTCCGTG
AAGGAACTCT TGGGAATCAC TATCATGGAA AGATCATCCT
```

-continued

```
TTGAAAAGAA CCCTATCGAT TTCCTGGAGG CTAAGGGTTA

CAAGGAGGTC AAGAAAGACC TCATCATTAA ACTGCCAAAA

TACTCTCTCT TCGAGCTGGA AAATGGCAGG AAGAGAATGT

TGGCCAGCGC CGGAGAGCTG CAAAAGGGAA ACGAGCTTGC

TCTGCCCTCC AAATATGTTA ATTTTCTCTA TCTCGCTTCC

CACTATGAAA AGCTGAAAGG GTCTCCCGAA GATAACGAGC

AGAAGCAGCT GTTCGTCGAA CAGCACAAGC ACTATCTGGA

TGAAATAATC GAACAAATAA GCGAGTTCAG CAAAAGGGTT

ATCCTGGCGG ATGCTAATTT GGACAAAGTA CTGTCTGCTT

ATAACAAGCA CCGGGATAAG CCTATTAGGG AACAAGCCGA

GAATATAATT CACCTCTTTA CACTCACGAA TCTCGGAGCC

CCCGCCGCCT TCAAATACTT TGATACGACT ATCGACCGGA

AACGGTATAC CAGTACCAAA GAGGTCCTCG ATGCCACCCT

CATCCACCAG TCAATTACTG GCCTGTACGA AACACGGATC

GACCTCTCTC AACTGGGCGG CGACTAG
```

Provided below is the corresponding amino acid sequence of a *S. pyogenes* Cas9 molecule.

(SEQ ID NO: 139)
```
MDKKYSIGLDIGTNSVGWAVITDEYKVPSKKFKVLGNTDRHSIKKNLIGA
LLFDSGETAEATRLKRTARRRYTRRKNRICYLQEIFSNEMAKVDDSFFHR
LEESFLVEEDKKHERHPIFGNIVDEVAYHEKYPTIYHLRKKLVDSTDKAD
LRLIYLALAHMIKFRGHFLIEGDLNPDNSDVDKLFIQLVQTYNQLFEENP
INASGVDAKAILSARLSKSRRLENLIAQLPGEKKNGLFGNLIALSLGLTP
NFKSNFDLAEDAKLQLSKDTYDDDLDNLLAQIGDQYADLFLAAKNLSDAI
LLSDILRVNTEITKAPLSASMIKRYDEHHQDLTLLKALVRQQLPEKYKEI
FFDQSKNGYAGYIDGGASQEEFYKFIKPILEKMDGTEELLVKLNREDLLR
KQRTFDNGSIPHQIHLGELHAILRRQEDFYPFLKDNREKIEKILTFRIPY
YVGPLARGNSRFAWMTRKSEETITPWNFEEVVDKGASAQSFIERMTNFDK
NLPNEKVLPKHSLLYEYFTVYNELTKVKYVTEGMRKPAFLSGEQKKAIVD
LLFKTNRKVTVKQLKEDYFKKIECFDSVEISGVEDRFNASLGTYHDLLKI
IKDKDFLDNEENEDILEDIVLTLTLFEDREMIEERLKTYAHLFDDKVMKQ
LKRRRYTGWGRLSRKLINGIRDKQSGKTILDFLKSDGFANRNFMQLIHDD
SLTFKEDIQKAQVSGQGDSLHEHIANLAGSPAIKKGILQTVKVVDELVKV
MGRHKPENIVIEMARENQTTQKGQKNSRERMKRIEEGIKELGSQILKEHP
VENTQLQNEKLYLYYLQNGRDMYVDQELDINRLSDYDVDHIVPQSFLKDD
SIDNKVLTRSDKNRGKSDNVPSEEVVKKMKNYWRQLLNAKLITQRKFDNL
TKAERGGLSELDKAGFIKRQLVETRQITKHVAQILDSRMNTKYDENDKLI
REVKVITLKSKLVSDFRKDFQFYKVREINNYHHAHDAYLNAVVGTALIKK
YPKLESEFVYGDYKVYDVRKMIAKSEQEIGKATAKYFFYSNIMNFFKTEI
TLANGEIRKRPLIETNGETGEIVWDKGRDFATVRKVLSMPQVNIVKKTEV
QTGGFSKESILPKRNSDKLIARKKDWDPKKYGGFDSPTVAYSVLVVAKVE
KGKSKKLKSVKELLGITIMERSSFEKNPIDFLEAKGYKEVKKDLIIKLPK
YSLFELENGRKRMLASAGELQKGNELALPSKYVNFLYLASHYEKLKGSPE
DNEQKQLFVEQHKHYLDEIIEQISEFSKRVILADANLDKVLSAYNKHRDK
PIREQAENIIHLFTLTNLGAPAAFKYFDTTIDRKRYTSTKEVLDATLIHQ
SITGLYETRIDLSQLGGD*
```

Provided below is an exemplary codon optimized nucleic acid sequence encoding a Cas9 molecule of *N. meningitidis*.

(SEQ ID NO: 140)
```
ATGGCCGCCTTCAAGCCCAACCCCATCAACTACATCCTGGGCCTGGACAT
CGGCATCGCCAGCGTGGGCTGGGCCATGGTGGAGATCGACGAGGACGAGA
ACCCCATCTGCCTGATCGACCTGGGTGTGCGCGTGTTCGAGCGCGCTGAG
GTGCCCAAGACTGGTGACAGTCTGGCTATGGCTCGCCGGCTTGCTCGCTC
TGTTCGGCGCCTTACTCGCCGGCGCGCTCACCGCCTTCTGCGCGCTCGCC
GCCTGCTGAAGCGCGAGGGTGTGCTGCAGGCTGCCGACTTCGACGAGAAC
GGCCTGATCAAGAGCCTGCCCAACACTCCTTGGCAGCTGCGCGCTGCCGC
TCTGGACCGCAAGCTGACTCCTCTGGAGTGGAGCGCCGTGCTGCTGCACC
TGATCAAGCACCGCGGCTACCTGAGCCAGCGCAAGAACGAGGGCGAGACC
GCCGACAAGGAGCTGGGTGCTCTGCTGAAGGGCGTGGCCGACAACGCCCA
CGCCCTGCAGACTGGTGACTTCCGCACTCCTGCTGAGCTGGCCCTGAACA
AGTTCGAGAAGGAGAGCGGCCACATCCGCAACCAGCGCGGCGACTACAGC
CACACCTTCAGCCGCAAGGACCTGCAGGCCGAGCTGATCCTGCTGTTCGA
GAAGCAGAAGGAGTTCGGCAACCCCCACGTGAGCGGCGGCCTGAAGGAGG
GCATCGAGACCCTGCTGATGACCCAGCGCCCCGCCCTGAGCGGCGACGCC
GTGCAGAAGATGCTGGGCCACTGCACCTTCGAGCCAGCCGAGCCCAAGGC
CGCCAAGAACACCTACACCGCCGAGCGCTTCATCTGGCTGACCAAGCTGA
ACAACCTGCGCATCCTGGAGCAGGGCAGCGAGCGCCCCCTGACCGACACC
GAGCGCGCCACCCTGATGGACGAGCCCTACCGCAAGAGCAAGCTGACCTA
CGCCCAGGCCCGCAAGCTGCTGGGTCTGGAGGACACCGCCTTCTTCAAGG
GCCTGCGCTACGGCAAGGACAACGCCGAGGCCAGCACCCTGATGGAGATG
AAGGCCTACCACGCCATCAGCCGCGCCCTGGAGAAGGAGGGCCTGAAGGA
CAAGAAGAGTCCTCTGAACCTGAGCCCCGAGCTGCAGGACGAGATCGGCA
CCGCCTTCAGCCTGTTCAAGACCGACGAGGACATCACCGGCCGCCTGAAG
GACCGCATCCAGCCCGAGATCCTGGAGGCCCTGCTGAAGCACATCAGCTT
CGACAAGTTCGTGCAGATCAGCCTGAAGGCCCTGCGCCGCATCGTGCCCC
TGATGGAGCAGGGCAAGCGCTACGACGAGGCCTGCGCCGAGATCTACGGC
GACCACTACGGCAAGAAGAACACCGAGGAGAAGATCTACCTGCCTCCTAT
CCCCGCCGACGAGATCCGCAACCCCGTGGTGCTGCGCGCCCTGAGCCAGG
CCCGCAAGGTGATCAACGGCGTGGTGCGCCGCTACGGCAGCCCCGCCCGC
ATCCACATCGAGACCGCCCGCGAGGTGGGCAAGAGCTTCAAGGACCGCAA
GGAGATCGAGAAGCGCCAGGAGGAGAACCGCAAGGACCGCGAGAAGGCCG
```

```
CCGCCAAGTTCCGCGAGTACTTCCCCAACTTCGTGGGCGAGCCCAAGAGC
AAGGACATCCTGAAGCTGCGCCTGTACGAGCAGCAGCACGGCAAGTGCCT
GTACAGCGGCAAGGAGATCAACCTGGGCCGCCTGAACGAGAAGGGCTACG
TGGAGATCGACCACGCCCTGCCCTTCAGCCGCACCTGGGACGACAGCTTC
AACAACAAGGTGCTGGTGCTGGGCAGCGAGAACCAGAACAAGGGCAACCA
GACCCCCTACGAGTACTTCAACGGCAAGGACAACAGCCGCGAGTGGCAGG
AGTTCAAGGCCCGCGTGGAGACCAGCCGCTTCCCCCGCAGCAAGAAGCAG
CGCATCCTGCTGCAGAAGTTCGACGAGGACGGCTTCAAGGAGCGCAACCT
GAACGACACCCGCTACGTGAACCGCTTCCTGTGCCAGTTCGTGGCCGACC
GCATGCGCCTGACCGGCAAGGGCAAGAAGCGCGTGTTCGCCAGCAACGGC
CAGATCACCAACCTGCTGCGCGGCTTCTGGGGCCTGCGCAAGGTGCGCGC
CGAGAACGACCGCCACCACGCCCTGGACGCCGTGGTGGTGGCCTGCAGCA
CCGTGGCCATGCAGCAGAAGATCACCCGCTTCGTGCGCTACAAGGAGATG
AACGCCTTCGACGGTAAAACCATCGACAAGGAGACCGGCGAGGTGCTGCA
CCAGAAGACCCACTTCCCCCAGCCCTGGGAGTTCTTCGCCCAGGAGGTGA
TGATCCGCGTGTTCGGCAAGCCCGACGGCAAGCCCGAGTTCGAGGAGGCC
GACACCCCCGAGAAGCTGCGCACCCTGCTGGCCGAGAAGCTGAGCAGCCG
CCCTGAGGCCGTGCACGAGTACGTGACTCCTCTGTTCGTGAGCCGCGCCC
CCAACCGCAAGATGAGCGGTCAGGGTCACATGGAGACCGTGAAGAGCGCC
AAGCGCCTGGACGAGGGCGTGAGCGTGCTGCGCGTGCCCCTGACCCAGCT
GAAGCTGAAGGACCTGGAGAAGATGGTGAACCGCGAGCGCGAGCCCAAGC
TGTACGAGGCCCTGAAGGCCCGCCTGGAGGCCCACAAGGACGACCCCGCC
AAGGCCTTCGCCGAGCCCTTCTACAAGTACGACAAGGCCGGCAACCGCAC
CCAGCAGGTGAAGGCCGTGCGCGTGGAGCAGGTGCAGAAGACCGGCGTGT
GGGTGCGCAACCACAACGGCATCGCCGACAACGCCACCATGGTGCGCGTG
GACGTGTTCGAGAAGGGCGACAAGTACTACCTGGTGCCCATCTACAGCTG
GCAGGTGGCCAAGGGCATCCTGCCCGACCGCGCCGTGGTGCAGGGCAAGG
ACGAGGAGGACTGGCAGCTGATCGACGACAGCTTCAACTTCAAGTTCAGC
CTGCACCCCAACGACCTGGTGGAGGTGATCACCAAGAAGGCCCGCATGTT
CGGCTACTTCGCCAGCTGCCACCGCGGCACCGGCAACATCAACATCCGCA
TCCACGACCTGGACCACAAGATCGGCAAGAACGGCATCCTGGAGGGCATC
GGCGTGAAGACCGCCCTGAGCTTCCAGAAGTACCAGATCGACGAGCTGGG
CAAGGAGATCCGCCCCTGCCGCCTGAAGAAGCGCCCTCCTGTGCGCTAA
```

Provided below is the corresponding amino acid sequence of a *N. meningitidis* Cas9 molecule.

(SEQ ID NO: 141)
```
MAAFKPNPINYILGLDIGIASVGWAMVEIDEDENPICLIDLGVRVFERAE
VPKTGDSLAMARRLARSVRRLTRRRAHRLLRARRLLKREGVLQAADFDEN
GLIKSLPNTPWQLRAAALDRKLTPLEWSAVLLHLIKHRGYLSQRKNEGET
ADKELGALLKGVADNAHALQTGDFRTPAELALNKFEKESGHIRNQRGDYS
HTFSRKDLQAELILLFEKQKEFGNPHVSGGLKEGIETLLMTQRPALSGDA
VQKMLGHCTFEPAEPKAAKNTYTAERFIWLTKLNNLRILEQGSERPLTDT
ERATLMDEPYRKSKLTYAQARKLLGLEDTAFFKGLRYGKDNAEASTLMEM
KAYHAISRALEKEGLKDKKSPLNLSPELQDEIGTAFSLFKTDEDITGRLK
DRIQPEILEALLKHISFDKFVQISLKALRRIVPLMEQGKRYDEACAEIYG
DHYGKKNTEEKIYLPPIPADEIRNPVVLRALSQARKVINGVVRRYGSPAR
IHIETAREVGKSFKDRKEIEKRQEENRKDREKAAAKFREYFPNFVGEPKS
KDILKLRLYEQQHGKCLYSGKEINLGRLNEKGYVEIDHALPFSRTWDDSF
NNKVLVLGSENQNKGNQTPYEYFNGKDNSREWQEFKARVETSRFPRSKKQ
RILLQKFDEDGFKERNLNDTRYVNRFLCQFVADRMRLTGKGKKRVFASNG
QITNLLRGFWGLRKVRAENDRHHALDAVVVACSTVAMQQKITRFVRYKEM
NAFDGKTIDKETGEVLHQKTHFPQPWEFFAQEVMIRVFGKPDGKPEFEEA
DTPEKLRTLLAEKLSSRPEAVHEYVTPLFVSRAPNRKMSGQGHMETVKSA
KRLDEGVSVLRVPLTQLKLKDLEKMVNREREPKLYEALKARLEAHKDDPA
KAFAEPFYKYDKAGNRTQQVKAVRVEQVQKTGVWVRNHNGIADNATMVRV
DVFEKGDKYYLVPIYSWQVAKGILPDRAVVQGKDEEDWQLIDDSFNFKFS
LHPNDLVEVITKKARMFGYFASCHRGTGNINIRIHDLDHKIGKNGILEGI
GVKTALSFQKYQIDELGKEIRPCRLKKRPPVR*
```

Provided below is an amino acid sequence of a *S. aureus* Cas9 molecule.

(SEQ ID NO: 142)
```
MKRNYILGLDIGITSVGYGIIDYETRDVIDAGVRLFKEANVENNEGRRSK
RGARRLKRRRRHRIQRVKKLLFDYNLLTDHSELSGINPYEARVKGLSQKL
SEEEFSAALLHLAKRRGVHNVEVEEDTGNELSTKEQISRNSKALEEKYV
AELQLERLKKDGEVRGSINRFKTSDYVKEAKQLLKVQKAYHQLDQSFIDT
YIDLLETRRTYYEGPGEGSPFGWKDIKEWYEMLMGHCTYFPEELRSVKYA
YNADLYNALNDLNNLVITRDENEKLEYYEKFQIIENVFKQKKKPTLKQIA
KEILVNEEDIKGYRVTSTGKPEFTNLKVYHDIKDITARKEIIENAELLDQ
IAKILTIYQSSEDIQEELTNLNSELTQEEIEQISNLKGYTGTHNLSLKAI
NLILDELWHTNDNQIAIFNRLKLVPKKVDLSQQKEIPTTLVDDFILSPVV
KRSFIQSIKVINAIIKKYGLPNDIIIELAREKNSKDAQKMINEMQKRNRQ
TNERIEEIIRTTGKENAKYLIEKIKLHDMQEGKCLYSLEAIPLEDLLNNP
FNYEVDHIIPRSVSFDNSFNNKVLVKQEENSKKGNRTPFQYLSSSDSKIS
YETFKKHILNLAKGKGRISKTKKEYLLEERDINRFSVQKDFINRNLVDTR
YATRGLMNLLRSYFRVNNLDVKVKSINGGFTSFLRRKWKFKKERNKGYKH
HAEDALIIANADFIFKEWKKLDKAKKVMENQMFEEKQAESMPEIETEQEY
KEIFITPHQIKHIKDFKDYKYSHRVDKKPNRELINDTLYSTRKDDKGNTL
IVNNLNGLYDKDNDKLKKLINKSPEKLLMYHHDPQTYQKLKLIMEQYGDE
KNPLYKYYEETGNYLTKYSKKDNGPVIKKIKYYGNKLNAHLDITDDYPNS
```

-continued
RNKVVKLSLKPYRFDVYLDNGVYKFVTVKNLDVIKKENYYEVNSKCYEEA

KKLKKISNQAEFIASFYNNDLIKINGELYRVIGVNNDLLNRIEVNMIDIT

YREYLENMNDKRPPRIIKTIASKTQSIKKYSTDILGNLYEVKSKKHPQII

KKG*

Provided below is an exemplary codon optimized nucleic acid sequence encoding a Cas9 molecule of *S. aureus* Cas9.

(SEQ ID NO: 143)
ATGAAAAGGAACTACATTCTGGGGCTGGACATCGGGATTACAAGCGTGGG

GTATGGGATTATTGACTATGAAACAAGGGACGTGATCGACGCAGGCGTCA

GACTGTTCAAGGAGGCCAACGTGGAAAACAATGAGGGACGGAGAAGCAAG

AGGGGAGCCAGGCGCCTGAAACGACGGAGAAGGCACAGAATCCAGAGGGT

GAAGAAACTGCTGTTCGATTACAACCTGCTGACCGACCATTCTGAGCTGA

GTGGAATTAATCCTTATGAAGCCAGGGTGAAAGGCCTGAGTCAGAAGCTG

TCAGAGGAAGAGTTTTCCGCAGCTCTGCTGCACCTGGCTAAGCGCCGAGG

AGTGCATAACGTCAATGAGGTGGAAGAGGACACCGGCAACGAGCTGTCTA

CAAAGGAACAGATCTCACGCAATAGCAAAGCTCTGGAAGAGAAGTATGTC

GCAGAGCTGCAGCTGGAACGGCTGAAGAAAGATGGCGAGGTGAGAGGGTC

AATTAATAGGTTCAAGACAAGCGACTACGTCAAAGAAGCCAAGCAGCTGC

TGAAAGTGCAGAAGGCTTACCACCAGCTGGATCAGAGCTTCATCGATACT

TATATCGACCTGCTGGAGACTCGGAGAACCTACTATGAGGGACCAGGAGA

AGGGAGCCCCTTCGGATGGAAAGACATCAAGGAATGGTACGAGATGCTGA

TGGGACATTGCACCTATTTTCCAGAAGAGCTGAGAAGCGTCAAGTACGCT

TATAACGCAGATCTGTACAACGCCCTGAATGACCTGAACAACCTGGTCAT

CACCAGGGATGAAAACGAGAAACTGGAATACTATGAGAAGTTCCAGATCA

TCGAAAACGTGTTTAAGCAGAAGAAAAAGCCTACACTGAAACAGATTGCT

AAGGAGATCCTGGTCAACGAAGAGGACATCAAGGGCTACCGGGTGACAAG

CACTGGAAAACCAGAGTTCACCAATCTGAAAGTGTATCACGATATTAAGG

ACATCACAGCACGGAAAGAAATCATTGAGAACGCCGAACTGCTGGATCAG

ATTGCTAAGATCCTGACTATCTACCAGAGCTCCGAGGACATCCAGGAAGA

GCTGACTAACCTGAACAGCGAGCTGACCCAGGAAGAGATCGAACAGATTA

GTAATCTGAAGGGGTACACCGGAACACACAACCTGTCCCTGAAAGCTATC

AATCTGATTCTGGATGAGCTGTGGCATACAAACGACAATCAGATTGCAAT

CTTTAACCGGCTGAAGCTGGTCCCAAAAAAGGTGGACCTGAGTCAGCAGA

AAGAGATCCCAACCACACTGGTGGACGATTTCATTCTGTCACCCGTGGTC

AAGCGGAGCTTCATCCAGAGCATCAAAGTGATCAACGCCATCATCAAGAA

GTACGGCCTGCCCAATGATATCATTATCGAGCTGGCTAGGGAGAAGAACA

GCAAGGACGCACAGAAGATGATCAATGAGATGCAGAAACGAAACCGGCAG

ACCAATGAACGCATTGAAGAGATTATCCGAACTACCGGGAAAGAGAACGC

AAAGTACCTGATTGAAAAAATCAAGCTGCACGATATGCAGGAGGGAAAGT

GTCTGTATTCTCTGGAGGCCATCCCCCTGGAGGACCTGCTGAACAATCCA

TTCAACTACGAGGTCGATCATATTATCCCCAGAAGCGTGTCCTTCGACAA

-continued
TTCCTTTAACAACAAGGTGCTGGTCAAGCAGGAAGAGAACTCTAAAAAGG

GCAATAGGACTCCTTTCCAGTACCTGTCTAGTTCAGATTCCAAGATCTCT

TACGAAACCTTTAAAAAGCACATTCTGAATCTGGCCAAAGGAAAGGGCCG

CATCAGCAAGACCAAAAAGGAGTACCTGCTGGAAGAGCGGGACATCAACA

GATTCTCCGTCCAGAAGGATTTTATTAACCGGAATCTGGTGGACACAAGA

TACGCTACTCGCGGCCTGATGAATCTGCTGCGATCCTATTTCCGGGTGAA

CAATCTGGATGTGAAAGTCAAGTCCATCAACGGCGGGTTCACATCTTTTC

TGAGGCGCAAATGGAAGTTTAAAAAGGAGCGCAACAAAGGGTACAAGCAC

CATGCCGAAGATGCTCTGATTATCGCAAATGCCGACTTCATCTTTAAGGA

GTGGAAAAAGCTGGACAAAGCCAAGAAAGTGATGGAGAACCAGATGTTCG

AAGAGAAGCAGGCCGAATCTATGCCCGAAATCGAGACAGAACAGGAGTAC

AAGGAGATTTTCATCACTCCTCACCAGATCAAGCATATCAAGGATTTCAA

GGACTACAAGTACTCTCACCGGGTGGATAAAAAGCCCAACAGAGAGCTGA

TCAATGACACCCTGTATAGTACAAGAAAAGACGATAAGGGGAATACCCTG

ATTGTGAACAATCTGAACGGACTGTACGACAAAGATAATGACAAGCTGAA

AAAGCTGATCAACAAAAGTCCCGAGAAGCTGCTGATGTACCACCATGATC

CTCAGACATATCAGAAACTGAAGCTGATTATGGAGCAGTACGGCGACGAG

AAGAACCCACTGTATAAGTACTATGAAGAGACTGGGAACTACCTGACCAA

GTATAGCAAAAAGGATAATGGCCCCGTGATCAAGAAGATCAAGTACTATG

GGAACAAGCTGAATGCCCATCTGGACATCACAGACGATTACCCTAACAGT

CGCAACAAGGTGGTCAAGCTGTCACTGAAGCCATACAGATTCGATGTCTA

TCTGGACAACGGCGTGTATAAATTTGTGACTGTCAAGAATCTGGATGTCA

TCAAAAAGGAGAACTACTATGAAGTGAATAGCAAGTGCTACGAAGAGGCT

AAAAAGCTGAAAAAGATTAGCAACCAGGCAGAGTTCATCGCCTCCTTTTA

CAACAACGACCTGATTAAGATCAATGGCGAACTGTATAGGGTCATCGGGG

TGAACAATGATCTGCTGAACCGCATTGAAGTGAATATGATTGACATCACT

TACCGAGAGTATCTGGAAAACATGAATGATAAGCGCCCCCCTCGAATTAT

CAAAACAATTGCCTCTAAGACTCAGAGTATCAAAAAGTACTCAACCGACA

TTCTGGGAAACCTGTATGAGGTGAAGAGCAAAAAGCACCCTCAGATTATC

AAAAAGGGC

If any of the above Cas9 sequences are fused with a peptide or polypeptide at the C-terminus, it is understood that the stop codon will be removed.

Other Cas Molecules and Cas Polypeptides

Various types of Cas molecules or Cas polypeptides can be used to practice the inventions disclosed herein. In some embodiments, Cas molecules of Type II Cas systems are used. In other embodiments, Cas molecules of other Cas systems are used. For example, Type I or Type III Cas molecules may be used. Exemplary Cas molecules (and Cas systems) are described, e.g., in Haft et al. (2005) PLoS COMPUTATIONAL BIOLOGY 1(6): e60, and in Makarova et al. (2011) NATURE REVIEW MICROBIOLOGY 9:467-477, the contents of which are incorporated herein by reference in their entirety. Exemplary Cas molecules (and Cas systems) are also shown in Table 600.

TABLE 600

Cas Systems

| Gene name‡ | System type or subtype | Name from Haft et al.§ | Structure of encoded protein (PDB accessions)¶ | Families (and superfamily) of encoded protein#** | Representatives |
|---|---|---|---|---|---|
| cas1 | Type I<br>Type II<br>Type III | cas1 | 3GOD, 3LFX and 2YZS | COG1518 | SERP2463, SPy 1047 and ygbT |
| cas2 | Type I<br>Type II<br>Type III | cas2 | 2IVY, 2I8E and 3EXC | COG1343 and COG3512 | SERP2462, SPy 1048, SPy 1723 (N-terminal domain) and ygbF |
| cas3' | Type I‡‡ | cas3 | NA | COG1203 | APE1232 and ygcB |
| cas3" | Subtype I-A<br>Subtype I-B | NA | NA | COG2254 | APE1231 and BH0336 |
| cas4 | Subtype I-A<br>Subtype I-B<br>Subtype I-C<br>Subtype I-D<br>Subtype II-B | cas4 and csa1 | NA | COG1468 | APE1239 and BH0340 |
| cas5 | Subtype I-A<br>Subtype I-B<br>Subtype I-C<br>Subtype I-E | cas5a, cas5d, cas5e, cas5h, cas5p, cas5t and cmx5 | 3KG4 | COG1688 (RAMP) | APE1234, BH0337, devS and ygcI |
| cas6 | Subtype I-A<br>Subtype I-B<br>Subtype I-D<br>Subtype III-A<br>Subtype III-B | cas6 and cmx6 | 3I4H | COG1583 and COG5551 (RAMP) | PF1131 and slr7014 |
| cas6e | Subtype I-E | cse 3 | 1WJ9 | (RAMP) | ygcH |
| cas6f | Subtype I-F | csy4 | 2XLJ | (RAMP) | y 1727 |
| cas7 | Subtype I-A<br>Subtype I-B<br>Subtype I-C<br>Subtype I-E | csa2, csd2, cse4, csh2, csp1 and cst 2 | NA | COG1857 and COG3649 (RAMP) | devR and ygcJ |
| cas8a1 | Subtype I-A‡‡ | cmx1, cst1, csx8, csx13 and CXXC-CXXC | NA | BH0338-like | LA3191§§ and PG2018§§ |
| cas8a2 | Subtype I-A‡‡ | csa4 and csx9 | NA | PH0918 | AF0070, AF1873, MJ0385, PF0637, PH0918 and SSO1401 |
| cas8b | Subtype I-B‡‡ | csh1 and TM1802 | NA | BH0338-like | MTH1090 and TM1802 |
| cas8c | Subtype I-C‡‡ | csd1 and csp2 | NA | BH0338-like | BH0338 |
| cas9 | Type II‡‡ | csn1 and csx12 | NA | COG3513 | FTN 0757 and SPy 1046 |
| cas10 | Type III‡‡ | cmr2, csm1 and csx11 | NA | COG1353 | MTH326, Rv2823c§§ and TM1794§§ |
| cas10d | Subtype I-D‡‡ | csc3 | NA | COG1353 | slr7011 |
| csy1 | Subtype I-F‡‡ | csy1 | NA | y 1724-like | y 1724 |
| csy2 | Subtype I-F | csy2 | NA | (RAMP) | y 1725 |
| csy3 | Subtype I-F | csy3 | NA | (RAMP) | y 1726 |
| cse1 | Subtype I-E‡‡ | cse 1 | NA | YgcL-like | ygcL |
| cse2 | Subtype I-E | cse 2 | 2ZCA | Ygck-like | ygck |
| csc1 | Subtype I-D | csc 1 | NA | alr1563-like (RAMP) | alr1563 |
| csc2 | Subtype I-D | csc1 and csc2 | NA | COG1337 (RAMP) | slr7012 |
| csa5 | Subtype I-A | csa5 | NA | AF1870 | AF1870, MJ0380, PF0643 and SSO1398 |
| csn2 | Subtype II-A | csn 2 | NA | SPy 1049-like | SPy 1049 |
| csm2 | Subtype III-A‡‡ | csm2 | NA | COG1421 | MTH1081 and SERP2460 |
| csm3 | Subtype III-A | csc2 and csm3 | NA | COG1337 (RAMP) | MTH1080 and SERP2459 |
| csm4 | Subtype III-A | csm4 | NA | COG1567 (RAMP) | MTH1079 and SERP2458 |
| csm5 | Subtype III-A | csm5 | NA | COG1332 (RAMP) | MTH1078 and SERP2457 |
| csm6 | Subtype III-A | APE2256 and csm6 | 2WTE | COG1517 | APE2256 and SSO1445 |

TABLE 600-continued

Cas Systems

| Gene name‡ | System type or subtype | Name from Haft et al.§ | Structure of encoded protein (PDB accessions)¶ | Families (and superfamily) of encoded protein#** | Representatives |
|---|---|---|---|---|---|
| cmr1 | Subtype III-B | cmr1 | NA | COG1367 (RAMP) | PF1130 |
| cmr3 | Subtype III-B | cmr3 | NA | COG1769 (RAMP) | PF1128 |
| cmr4 | Subtype III-B | cmr4 | NA | COG1336 (RAMP) | PF1126 |
| cmr5 | Subtype III-B‡‡ | cmr5 | 2ZOP and 2OEB | COG3337 | MTH324 and PF1125 |
| cmr6 | Subtype III-B | cmr6 | NA | COG1604 (RAMP) | PF1124 |
| csb1 | Subtype I-U | GSU0053 | NA | (RAMP) | Balac_1306 and GSU0053 |
| csb2 | Subtype I-USS | NA | NA | (RAMP) | Balac_1305 and GSU0054 |
| csb3 | Subtype I-U | NA | NA | (RAMP) | Balac_1303§§ |
| csx17 | Subtype I-U | NA | NA | NA | Btus_2683 |
| csx14 | Subtype I-U | NA | NA | NA | GSU0052 |
| csx10 | Subtype I-U | csx10 | NA | (RAMP) | Caur_2274 |
| csx16 | Subtype III-U | VVA 1548 | NA | NA | VVA1548 |
| csaX | Subtype III-U | csaX | NA | NA | SSO1438 |
| csx3 | Subtype III-U | csx3 | NA | NA | AF1864 |
| csx1 | Subtype III-U | csa3, csx1, csx2, DXTHG, NE0113 and TIGR02710 | 1XMX and 2I71 | COG1517 and COG4006 | MJ1666, NE0113, PF1127 and TM1812 |
| csx15 | Unknown | NA | NA | TTE2665 | TTE2665 |
| csf1 | Type U | csf1 | NA | NA | AFE_1038 |
| csf2 | Type U | csf2 | NA | (RAMP) | AFE_1039 |
| csf3 | Type U | csf3 | NA | (RAMP) | AFE_1040 |
| csf4 | Type U | csf4 | NA | NA | AFE_1037 |

IV. Linkers to Connect Cas9 Molecules or Cas9 Polypeptides to a Template Binding Domain In an embodiment, a linker covalently connects the Cas9 molecule to the template binding domain (e.g., a DNA binding domain).

In an embodiment, a linker is a short peptide sequence that connects protein domains. In another embodiment, a linker is a short peptide sequence that connects a protein domain and a nucleic acid (e.g., DNA or RNA). In an embodiment, a linker is a short peptide sequence that connects a protein domain and a small molecule. In an embodiment, a linker is a short peptide sequence that connects two small molecules. Linkers are often composed of flexible residues like glycine and serine so that the adjacent protein domains are free to move relative to one another. In certain embodiments, the linker has sufficient length and flexibility to allow the Cas9 molecule to bind to a target nucleic acid and simultaneously allow the target binding domain to associate with a nucleic acid template system, e.g., so that one binding event does not sterically block the other, and/or so that two adjacent domains do not sterically interfere with one another.

The linker can attach to the C-terminus or N-terminus of the Cas9 molecule.

The linker can attach to the C-terminus or N-terminus of the template binding domain.

The linker can attach to the C-terminus or N-terminus of the template binding domain partner.

The linker can attach to the C-terminus or N-terminus of the template nucleic acid.

In some embodiments, the linker length is from about 6 to 60 amino acids. The linker may be, e.g., 6-10, 10-15, 15-20, 20-30, 30-40, 40-50, or 50-60 amino acids in length. The linker may be, e.g., at least 6, 7, 8, 9, 10, 15, 20, 30, 40, or 50 amino acids in length. In other embodiments, the linker is, e.g., at most 7, 8, 9, 10, 15, 20, 30, 40, 50, or 60 amino acids in length. Ranges comprising any combination of these endpoints are also envisioned.

In some embodiments, the linker is encoded by a nucleic acid sequence of 6 to 60 nucleotides or base pairs. The nucleic acid may be, e.g., 6-10, 10-15, 15-20, 20-30, 30-40, 40-50, or 50-60 nucleotides in length. The linker may be, e.g., at least 6, 7, 8, 9, 10, 15, 20, 30, 40, or 50 nucleotides in length. In some embodiments, the linker is, e.g., at most 7, 8, 9, 10, 15, 20, 30, 40, 50, or 60 nucleotides in length. Ranges comprising any combination of these endpoints are also envisioned.

In some embodiments, the linker comprises glycine and serine residues. In some embodiments the linker consists of glycine and serine residues. For instance, the linker may comprise one of more modules such as GGS, GSGS, GGGS, GGGGS or GGSG. In some embodiments, the linker comprises a plurality of modules comprising glycine and serine, e.g., at least 2, 3, 4, 5, 10, or 15 of these modules, and/or at most 3, 4, 5, 10, 15, or 20 of these modules, or any combination of these endpoints. In some embodiments, each module in the linker has the same sequence, and in other embodiments, at least two modules in a linker have different sequences from each other.

In some embodiments, the linker is an XTEN linker or a variation of an XTEN linker such as SGSETPGTSESA (SEQ ID NO: 144), SGSETPGTSESATPES (SEQ ID NO: 2), or SGSETPGTSESATPEGGSGGS (SEQ ID NO: 145). Additional information on the XTEN linker may be found in Schellenberger et al. (2009), NATURE BIOTECHNOLOGY 27: 1186-1190, the entire contents of which are incorporated herein by reference.

Exemplary linker modules are given in Table 2:

GGS

GSGS (SEQ ID NO: 146)

GGGS (SEQ ID NO: 147)

GGGGS (SEQ ID NO: 148)

GGSG (SEQ ID NO: 149)

SGSETPGTSESA (SEQ ID NO: 150)

IPGTSESATPES (SEQ ID NO: 2)

SGSETPGTSESATPEGGSGGS (SEQ ID NO: 151)

Additional exemplary linker modules are given in Table 3:

| Name | Description | Length (nt) |
|---|---|---|
| BBa_J176131 | PLrigid | 60 |
| BBa_J18920 | 2aa GS linker | 6 |
| BBa_J18921 | 6aa [GS]x linker (SEQ ID NO: 152) | 18 |
| BBa_J18922 | 10aa [GS]x linker (SEQ ID NO: 153) | 30 |
| BBa_K105012 | 10 aa flexible protein domain linker | 30 |
| BBa_K133132 | 8 aa protein domain linker | 24 |
| BBa_K1486003 | flexible linker 2x (GGGS) (SEQ ID NO: 154) | 24 |
| BBa_K1486004 | flexible linker 2x (GGGGS) (SEQ ID NO: 155) | 30 |
| BBa_K1486037 | linker | 39 |
| BBa_K157009 | Split fluorophore linker; Freiburg standard | 51 |
| BBa_K157013 | 15 aa flexible glycine-serine protein domain linker; Freiburg standard | 45 |
| BBa_K243004 | Short Linker (Gly-Gly-Ser-Gly) (SEQ ID NO: 156) | 12 |
| BBa_K243005 | Middle Linker ( Gly-Gly-Ser-Gly)x2 (SEQ ID NO: 157) | 24 |
| BBa_K243006 | Long Linker (Gly-Gly-Ser-Gly)x3 (SEQ ID NO: 158) | 36 |
| BBa_K243029 | GSAT Linker | 108 |
| BBa_K243030 | SEG | 108 |
| BBa_K404300 | SEG-Linker | 108 |
| BBa_K404301 | GSAT-Linker | 108 |
| BBa_K404303 | Z-EGFR-1907_Short-Linker | 192 |
| BBa_K404304 | Z-EGFR-1907_Middle-Linker | 204 |
| BBa_K404305 | Z-EGFR-1907_Long-Linker | 216 |
| BBa_K404306 | Z-EGFR-1907_SEG-Linker | 288 |
| BBa_K416001 | (Gly4Ser)3 Flexible Peptide Linker (SEQ ID NO: 159) | 45 |
| BBa_K648005 | Short Fusion Protein Linker: GGSG with standard 25 prefix/suffix (SEQ ID NO: 160) | 12 |
| BBa_K648006 | Long 10AA Fusion Protein Linker with Standard 25 Prefix/Suffix | 30 |
| BBa_K648007 | Medium 6AA Fusion Protein Linker: GGSGGS (SEQ ID NO: 161) with Standard 25 Prefix/Suffix | 18 |

Linkers can comprise a direct bond or an atom such as, e.g., an oxygen (O) or sulfur (S), a unit such as —NR— wherein R is hydrogen or alkyl, —C(O)—, —C(O)O—, —C(O)NH—, SO, SO$_2$, —SO$_2$NH— or a chain of atoms, such as substituted or unsubstituted alkyl, substituted or unsubstituted alkenyl, substituted or unsubstituted alkynyl, arylalkyl, heteroarylalkyl. In some embodiments, one or more methylenes in the chain of atoms can be replaced with one or more of O, S, S(O), SO$_2$, —SO$_2$NH—, —NR—, —NR$_2$, —C(O)—, —C(O)O—, —C(O)NH—, a cleavable linking group, substituted or unsubstituted aryl, substituted or unsubstituted heteroaryl, and substituted or unsubstituted heterocyclic.

In some embodiments, the template binding domain is attached to the Cas9 molecule through a linker that is itself stable under physiological conditions, such as an alkylene chain, and does not result in release of the template binding domain from the Cas9 molecule for at least 2, 3, 4, 5, 10, 15, 24 or 48 hours or for at least 1, 2, 3, 4, 5 or 10 days when administered to a subject. In some embodiments, the template binding domain and the Cas9 molecule comprise residues of a functional groups through which reaction and linkage of the template binding domain to the Cas9 molecule was achieved. In some embodiments, the functional groups, which may be the same or different, terminal or internal, of the template binding domain or Cas9 molecule comprise an amino, acid, imidazole, hydroxyl, thio, acyl halide, —HC=CH—, —C≡C— group, or derivative thereof. In some embodiments, the linker comprises a hydrocarbylene group wherein one or more methylene groups is optionally replaced by a group Y (provided that none of the Y groups are adjacent to each other), wherein each Y, independently for each occurrence, is selected from, substituted or unsubstituted aryl, heteroaryl, cycloalkyl, heterocycloalkyl, or —O—, C(=X) (wherein X is NR$_1$, O or S), —NR$_1$—, —NR$_1$C(O)—, —C(O)NR$_1$—, S(O)$_n$—, —NR$_1$S(O)$_n$—, S(O)$_n$—NR$_1$—, —NR$_1$C(O)—NR$_1$—; and R$_1$, independently for each occurrence, represents H or a lower alkyl and wherein n is 0, 1, or 2.

In some embodiments, the linker comprises an alkylene moiety or a heteroalkylene moiety (e.g., an alkylene glycol moiety such as ethylene glycol). In some embodiments, a linker comprises a poly-L-glutamic acid, polylactic acid, poly(ethyleneimine), an oligosaccharide, an amino acid (e.g., glycine), an amino acid chain, or any other suitable linkage. The linker groups can be biologically inactive, such as a PEG, polyglycolic acid, or polylactic acid chain. In certain embodiments, the linker group represents a derivatized or non-derivatized amino acid (e.g., glycine).

The Cas9 molecule attached to the linker may be any Cas9 molecule described herein, e.g., a Cas9 molecule of Section III, e.g., a nickase or a Cas9 molecule capable of making a double stranded break. The template binding domain attached to the linker may be any template binding domain described herein, e.g., a template binding domain of Section V, e.g., a DNA-binding domain.

V. Template Binding Domains

In some embodiments, the template binding domain comprises a plurality of domains that bind a template binding domain partner, e.g., DNA-binding molecules. For instance, a first DNA-binding molecule and a second DNA-binding molecule may, on their own, be poor choices because each has a low affinity and optionally also a short recognition sequence that is present in multiple copies in the genome of the cell to be altered. However, when combined, the first and second molecules could give a higher affinity and optionally also a longer recognition sequence that is rarer in the genome of the cell to be altered. Accordingly, in some embodiments, the template binding domain comprises a plurality of domains that bind a template binding domain partner, e.g., DNA-binding molecules. For instance, the template binding domain may comprise two or more, three or more, four or more, five or more, ten or more, 2-4, 4-6, 6-8, or 8-10 domains that bind a template binding domain partner, e.g., DNA-binding molecules.

The template binding domain can be covalently bound to the Cas9 molecule, e.g., using a linker. The template binding domain and the Cas9 can be part of the same fusion protein. In some embodiments, the Cas9 molecule and the template binding domain are part of the same gene and are transcribed to form a single mRNA which is then translated into a single protein. In other embodiments, the Cas9 molecule and the template binding domain are produced separately and then joined covalently or non-covalently. An example of a template binding domain which binds non-covalently to the Cas9 molecule is a template-binding domain that comprises a region with specific affinity for Cas9, e.g., an antibody that recognizes Cas9, e.g., an scFv antibody or another type of antibody that contains sufficient CDR sequences for binding to Cas9. In some embodiments, the template binding domain is derived from a wild-type protein. For example, the template binding domain may be a fragment of a wild type protein, a mutagenized wild type protein, a mutagenized wild-type protein fragment, a synthetic protein that has been modeled after the three dimensional structure of a naturally-occurring protein. In some embodiments, the template binding domain is mutagenized to increase its affinity for a template binding domain partner. In some embodiments, the template binding domain is mutagenized to decrease its affinity for a template binding domain partner.

V.1 Template Binding Domains that are DNA-Binding Polypeptides

In some embodiments, the template binding domain is a polypeptide, e.g., a protein or protein domain. This polypeptide can bind to the major groove of a target DNA sequence and/or a minor groove of a target DNA sequence. It can comprise one or more of the following domains: zinc finger, helix-turn-helix, leucine zipper, winged helix, winged helix turn helix, helix-loop-helix, HMG-box, and Wor3 domain. It can bind single stranded DNA or double stranded DNA. In some embodiments, the DNA-binding polypeptide is identical in sequence to a wild-type protein, and in other embodiments it comprises one or more mutations, e.g., deletions, relative to a wild-type protein.

In some embodiments, the DNA-binding polypeptide comprises a mutation relative to a wild-type DNA-binding protein. For example, if the wild-type DNA-binding protein must bind a ligand or co-activator before it can bind DNA, the DNA-binding polypeptide is optionally mutated to a constitutively active form. Similarly, if the wild-type DNA-binding protein is incapable of binding to DNA in the presence of a ligand or co-activator before it can bind DNA, the DNA-binding polypeptide can also be mutated to a constitutively active form. In some embodiments, the DNA-binding polypeptide carries a deletion relative to a wild-type protein, e.g., a transcriptional activation or repression domain or a catalytic domain is removed. In some embodiments, the DNA-binding polypeptide consists only of the DNA-binding region of the corresponding wild-type DNA-binding protein.

In some embodiments, the DNA-binding polypeptide recognizes chemically modified DNA, e.g., methylated DNA. In some embodiments, the DNA-binding polypeptide recognizes a chemical modification that is rare in or absent from the genome of the cell to be altered. This can help avoid the DNA-binding polypeptide non-specifically binding to the cell's genome.

Several exemplary DNA binding proteins are given below.

Operon

In some embodiments, the DNA-binding polypeptide is, or is derived from, a DNA-binding protein from an operon, e.g., a bacterial operon. The DNA-binding polypeptide may be, e.g., a repressor or an activator in the context of the operon. Generally, the DNA-binding polypeptide will not activate or repress transcription in the methods described herein. This can be achieved by, e.g., mutating transcriptional regulation domains, or choosing a DNA-binding polypeptide that does not engage the transcriptional machinery of the cell to be altered. For example, when altering the genome of a human cell, one could choose a DNA-binding peptide from a prokaryote, Archaea, single celled eukaryote, plant, or fungus.

DNA-binding proteins from operons, and the nucleotide sequences to which they bind, are known in the art (see, e.g., Postle et al. (1984) NUCLEIC ACIDS RES. 12: 4849-63; Buvinger and Riley (1985) J. BACTERIOL. 163: 850-7; Laughon and Gesteland (1984) MOL. CELL BIOL. 4:260-7; Bram et al. (1986) EMBO J. 5: 603-8; Von Wilcken-Bergmann & Muller-Hill (1982) PROC. NAT'L. ACAD. SCI. 79: 2427-31; Heinrich et al. (1989) NUCLEIC ACIDS RES. 17: 7681-92; Osborne et al. (1989) NUCLEIC ACIDS RES. 17: 7671-80; Singleton et al. (1980) NUCLEIC ACIDS RES. 8: 1551-60; Widdowson et al. (1996) ANTIMICROB. AGENTS CHEMOTHER. 40: 2891-93; Oehler et al. (1994) EMBO J. 13: 3348-55; Bailone and Galibert (1980) NUCLEIC ACIDS RES. 8: 2147-64; and, Staacke et al. (1990) EMBO J. 9: 1963-7).

Exemplary DNA-binding proteins from operons are given in the table below. The template-binding domain may comprise one or more of these proteins or polypeptides derived therefrom.

TABLE V.1

DNA-binding proteins from operons

| Template binding domain | DNA sequence recognized by the template binding domain |
|---|---|
| TetR repressor | Tet-O |
| LacI repressor | Lac operon 01 |
| Gal4 repressor | UAS |
| Repressor protein C1 | Operator L and R |
| Trp repressor | Trp operator |

Transcription Factors

In some embodiments, the DNA-binding polypeptide is, or is derived from, a transcription factor. The DNA-binding polypeptide may be or be derived from, e.g., a repressor or an activator in its wild-type context. Generally, the DNA-binding polypeptide will not activate or repress transcription in the methods described herein. This can be achieved by, e.g., mutating transcriptional regulation domains, such as the trans-activating domain (TAD) or any other domain that binds a transcription co-regulator. This can also be achieved by choosing a DNA-binding polypeptide that does not engage the transcriptional machinery of the cell to be altered. For example, when altering the genome of a human cell, one could choose a DNA-binding peptide from a prokaryote, Archaea, single celled eukaryote, plant, or fungus.

The transcription factor, in some embodiments, falls into one or more of several categories as set out here. The transcription factor may be a specific transcription factor and/or an upstream transcription factor. It may be constitutively active or conditionally active. If conditionally active, it may be developmental or signal-dependent. In some embodiments, the transcription factor is a resident nuclear factor and/or comprises a nuclear localization signal (NLS).

Exemplary transcription factors are given in the table below. The template-binding domain may comprise one or more of these transcription factors or polypeptides derived therefrom.

TABLE V.2

Transcription factors
Template binding domain
Yeast transcription factors

FHL1
ROX1
CMR3
SUT2
GAL4
USV1
AFT2
CUP9
TBF1
GCR1
MET31
ECM23
RDR1
HAP5
TYE7
YRM1
YRR1
AZF1
CIN5
MSN1
MSN1
INO4
HAL9
HAL9
YAP7
YAP7
DAL82
RAP1
SKO1
FKH2
CRZ1
RGM1
CEP3
MCM1
MSN2
MAC1
STB4
SOK2
ARG81
ORC1
YOX1
YAP1
LEU3
LEU3
SFP1
HAP1
ECM22
ECM22
ACE2
CHA4
GAT3
BAS1
ABF1
HAP4
MSN4
PHD1
PHD1
RGT1
RSF2
CBF1

TABLE V.2-continued

GZF3
ZAP1
YAP5
GAT4
FKH1
XBP1
CST6
SKN7
STB5
NDT80
STE12
STP2
RIM101
YAP3
YAP3
HAP2
MIG2
TOS8
AFT1
MIG1
PDR1
PHO4
HAC1
GAT1
RPH1
SPT15
COM2
SWI4
DOT6
GLN3
MIG3
GCN4
URC2
STP1
YHP 1
CAD1
CAD1
ARO80
SUM1
RSC3
YAP6
MET32
ADR1
UPC2
UME6
STB3
SWI5
INO2
GIS1
NRG1
LYS14
LYS14
UGA3
PHO2
MBP1
RPN4
RDS1
HCM1
MATALPHA2
REI1
THI2
TBS1
TBS1
TEC1
NRG2
REB1
EDS1
TOD6
HAP3

Transcription factor families found, e.g., in plants

ABI3VP1 family
CAMTA family
LFY family
SBP family
Alfin-like family
CCAAT family
LIM family
Sigma70-like family

TABLE V.2-continued

AP2-EREBP family
CPP family
LOB family
SRS family
ARF family
CSD family
MADS family
TAZ family
ARR-B family
DBP family
mTERF family
TCP family
BBR/BPC family
E2F-DP family
MYB family
Tify family
BES1 family
EIL family
MYB-related family
TIG family
bHLH family
FARI family
NAC family
Trihelix family
BSD family
FHA family
NOZZLE family
TUB family
bZIP family
G2-like family
OFP family
ULT family
C2C2-CO-like family
GeBP family
Orphans family
VARL family
C2C2-Dof family
GRAS family
PBF-2-like family
VOZ family
C2C2-GATA family
GRF family
PLATZ family
WRKY family
C2C2-YABBY family
HB family
RWP-RK family
zf-HD family
C2H2 family
HRT family
S1Fa-like family
Zn-clus family
C3H family
HSF family
SAP family Endonucleases In some embodiments, the DNA-binding polypeptide is derived from an endonuclease. The DNA-binding domain may be a catalytically inactive endonuclease, e.g., may have a substitution in or deletion of the domain that catalyzes DNA cleavage. If the endonuclease has other activities such as DNA modification activity, one may introduce mutations into the other active domains as well.

The restriction endonuclease may be, e.g., of Type I; Type II, e.g., Type IIR, Type IIS, or Type IIG; Type III; or Type IV.

In some embodiments where the endonuclease has a short recognition sequence, it may be used in combination with other DNA-binding polypeptides, e.g., other endonuclease-derived polypeptides, to achieve higher affinity binding to a longer recognition site.

In some embodiments, the endonuclease recognizes modified DNA, e.g., methylated DNA, and the template binding domain partner comprises modified DNA.

Exemplary restriction endonucleases are given in the table below. The template-binding domain may comprise one or more of these endonucleases or polypeptides derived therefrom.

TABLE V.3

| Endonucleases |
|---|
| Restriction endonucleases |
| AatII |
| AbaSI |
| Acc65I |
| AccI |
| AciI |
| AclI |
| AcuI |
| AfeI |
| AflII |
| AflIII |
| AgeI |
| AhdI |
| AleI |
| AluI |
| AlwI |
| AlwNI |
| ApaI |
| ApaLI |
| ApeKI |
| ApoI |
| AscI |
| AseI |
| AsiSI |
| AvaI |
| AvaII |
| AvrII |
| BaeGI |
| BaeI |
| BamHI |
| BanI |
| BanII |
| BbsI |
| BbvCI |
| BbvI |
| BccI |
| BceAI |
| BcgI |
| BciVI |
| BclI |
| BcoDI |
| BfaI |
| BfuAI |
| BfuCI |
| BglI |
| BglII |
| BlpI |
| BmgBI |
| BmrI |
| BmtI |
| BpmI |
| Bpu10I |
| BpuEI |
| BsaAI |
| BsaBI |
| BsaHI |
| BsaI |
| BsaJI |
| BsaWI |
| BsaXI |
| BseRI |
| BseYI |
| BsgI |
| BsiEI |
| BsiHKAI |
| BsiWI |
| BslI |
| BsmAI |
| BsmBI |
| BsmFI |
| BsmI |
| BsoBI |

TABLE V.3-continued

Endonucleases

- Bsp1286I
- BspCNI
- BspDI
- BspEI
- BspHI
- BspMI
- BspQI
- BsrBI
- BsrDI
- BsrFI
- BsrGI
- BsrI
- BssHII
- BssKI
- BssSI
- BstAPI
- BstBI
- BstEII
- BstNI
- BstUI
- BstXI
- BstYI
- BstZ17I
- Bsu36I
- BtgI
- BtgZI
- BtsCI
- BtsI
- BtsIMutI
- Cac8I
- ClaI
- CspCI
- CviAII
- CviKI-1
- CviQI
- DdeI
- DpnI
- DpnII
- DraI
- DraIII
- DrdI
- EaeI
- EagI
- EarI
- EciI
- Eco53kI
- EcoNI
- EcoO109I
- EcoP15I
- EcoRI
- EcoRV
- FatI
- FauI
- Fnu4HI
- FokI
- FseI
- FspEI
- FspI
- HaeII
- HaeIII
- HgaI
- HhaI
- HincII
- HindIII
- HinfI
- HinP1I
- HpaI
- HpaII
- HphI
- Hpy166II
- Hpy188I
- Hpy188III
- Hpy99I
- HpyAV
- HpyCH4III
- HpyCH4IV
- HpyCH4V
- I-CeuI
- I-SceI
- KasI
- KpnI
- LpnPI
- MboI
- MboII
- MfeI
- MluCI
- MluI
- MlyI
- MmeI
- MnlI
- MscI
- MseI
- MsII
- MspA1I
- MspI
- MspJI
- MwoI
- NaeI
- NarI
- Nb.BbvCI
- Nb.BsmI
- Nb.BsrDI
- Nb.BtsI
- NciI
- NcoI
- NdeI
- NgoMIV
- NheI
- NlaIII
- NlaIV
- NmeAIII
- NotI
- NruI
- NsiI
- NspI
- Nt.AlwI
- Nt.BbvCI
- Nt.BsmAI
- Nt.BspQI
- Nt.BstNBI
- Nt.CviPII
- PacI
- PaeR7I
- PciI
- PflFI
- PflMI
- PI-PspI
- PI-SceI
- PleI
- PluTI
- PmeI
- PmlI
- PpuMI
- PshAI
- PsiI
- PspGI
- PspOMI
- PspXI
- PstI
- PvuI
- PvuII
- RsaI
- RsrII
- SacI
- SacII
- SalI
- SapI
- Sau3AI
- Sau96I
- SbfI
- ScaI
- ScrFI
- SexAI
- SfaNI
- SfcI
- SfiI TABLE V.3-continued

| Endonucleases |
| --- |
| SfoI |
| SgrAI |
| SmaI |
| SmlI |
| SnaBI |
| SpeI |
| SphI |
| SphI |
| SspI |
| StuI |
| StyD4I |
| StyI |
| SwaI |
| TaqαI |
| TfiI |
| TliI |
| TseI |
| Tsp45I |
| Tsp509I |
| TspMI |
| TspRI |
| Tth111I |
| XbaI |
| XcmI |
| XhoI |
| XmaI |
| XmnI |
| ZraI |

TAL Effectors

In some embodiments, the DNA-binding polypeptide is, or is derived from, a TAL (transcription activator-like) effector. TAL effectors bind specifically to DNA through a series of 34-amino acid repeats, and engineering of these repeats tailors the specificity of the TAL effector to bind a desired DNA sequence. Details on how to engineer specificity are given in, e.g., U.S. Pat. No. 8,440,431. Briefly, each repeat in the TAL effector has a direct, linear correspondence with one nucleotide in the target site. Accordingly, one can readily engineer a TAL effector by selecting a first residue at position 12 and a second residue at position 13, in order to have that repeat bind to A, C, G, or T. Different repeats can be assembled to create a binding domain that is customized to recognize the desired target sequence. Table V.4 lists different combinations of amino acid residues that can be used to create repeats with specificity for a given nucleotide in the target binding sequence.

TABLE V.4

Code for designing a specific TAL effector

| 1$^{st}$ residue | 2$^{nd}$ residue | Nucleotide |
| --- | --- | --- |
| N | * | C or T |
| H | * | T |
| H | A | C |
| N | A | G |
| H | D | C |
| N | D | C |
| H | G | T |
| I | G | T |
| N | G | T |
| Y | G | T |
| N | I | A |
| H | I | C |
| N | K | G |
| H | N | G |
| S | N | G or A |
| N | N | G or A$^{1}$ |
| N | S | A or C or G$^{1}$ |

In some embodiments, the DNA-binding polypeptide is derived from a TALEN (TAL effector nuclease), and is mutated to lack nuclease activity. For example, there may be a substitution in or deletion of the domain that catalyzes DNA cleavage.

In some embodiments, the TAL effector is from, or is derived from, a TAL effector in a *Xanthomonas* bacterium, *Ralstonia solanacearum*, or *Burkholderia rhizoxinica*.

Exemplary TAL effectors and TALENs are given in the table below. The template-binding domain may comprise one or more of these TAL effectors and TALENs or polypeptides derived therefrom.

TABLE V.5

Publications describing TAL effectors and TALENs

Morbitzer, R. et al. (2010) "Regulation of selected genome loci using de novo-engineered transcription activator-like effector (TALE)-type transcription factors," PROCEEDINGS OF THE NATIONAL ACADEMY OF SCIENCES 107 (50): 21617-22. Bibcode: 2010PNAS..10721617M. doi:10.1073/pnas. 1013133107. PMC 3003021. PMID 21106758

Boch J. et al. (2009) "Breaking the code of DNA binding specificity of TAL-type III effectors," SCIENCE 326 (5959): 1509-12. Bibcode:2009Sci...326.1509B. doi:10.1126/science.1178811

Li, T. et al. (2011) "Modularly assembled designer TAL effector nucleases for targeted gene knockout and gene replacement in eukaryotes," NUCLEIC ACIDS RESEARCH 39:6315-25. doi:10.1093/nar/gkr188

Mahfouz, M.M. et al. (2011) "De novo-engineered transcription activator-like effector (TALE) hybrid nuclease with novel DNA binding specificity creates double-strand breaks," PROCEEDINGS OF THE NATIONAL ACADEMY OF SCIENCES 108 (6): 2623-8. doi:10.1073/pnas. 1019533108

Cermak, T. et al. (2011) "Efficient design and assembly of custom TALEN and other TAL effector-based constructs for DNA targeting," NUCLEIC ACIDS RESEARCH 39 (12): e82. doi:10.1093/nar/gkr218. PMC 3130291

Huang, P. et al. (2011) "Heritable gene targeting in zebrafish using customized TALENs," NATURE BIOTECHNOLOGY 29 (8): 699-700. doi:10.1038/nbt. 1939

Sander, J.D. et al. (2011) "Targeted gene disruption in somatic zebrafish cells using engineered TALENs," NATURE BIOTECHNOLOGY 29 (8): 697-8. doi:10.1038/nbt. 1934

Tesson, L. et al. (2011) "Knockout rats generated by embryo microinjection of TALENs," NATURE BIOTECHNOLOGY 29 (8): 695-6. doi:10.1038/nbt. 1940

V.2 Template Binding Domains that are Protein-Binding Polypeptides

In some embodiments, the template binding domain is a protein, and the template binding domain partner is a protein, and the template binding domain and the template binding domain partner have affinity for each other. Generally, when the template binding domain is a protein, it lacks substantial affinity for other proteins present in the cell to be altered. This helps to avoid nonspecific binding. In some embodiments, the template-binding domain is derived from a protein in another species than the species of the cell to be altered. In some embodiments, the template-binding domain is derived from a protein that has no binding partners that are expressed in the cell type to be altered.

In some embodiments, the protein-binding polypeptide comprises one of more of the following domains: SH2, SH3, PTB, 14-3-3, FHA, WW, WD40, bromo, chromo, EVH1, PDZ, DD, DED, CARD, BH1-4, CSD, F-box, Hect, RING, ANK, ARM, LIM, EF-hand, MH2.

In some embodiments, the template-binding domain comprises an antibody with affinity for the template binding domain partner. Conversely, in some embodiments, the template-binding domain is a protein and the template binding domain partner is an antibody with affinity for the template binding domain. The antibody may be, e.g., an scFv or any antibody having sufficient CDR sequences to bind its target.

In some embodiments, the template-binding domain carries one or more deletions relative to the wild-type protein from which it was derived. For example, there may be a deletion of a catalytic domain. In some embodiments, the wild-type protein has multiple protein-binding domains, one or more of these domains, e.g., all but one of these domains, is deleted.

Exemplary protein-binding domains are given in the table below. The template-binding domain may comprise one or more of these protein-binding domains or polypeptides derived therefrom. It is understood that in some embodiments, the template binding domain is, or is derived from, the protein in the left column and the template binding domain partner is, or is derived from, the protein in the right column. In other embodiments, the template binding domain is, or is derived from, the protein in the right column and the template binding domain partner is, or is derived from, the protein in the left column.

TABLE V.6

Protein-protein interaction domains

| Protein or domain | Binding partner |
| --- | --- |
| TE33 Fab L chain (BBa_K126000 from the Registry of Standard Biological Parts) | B subunit of cholera toxin |
| protein ZSPA-1 (BBa_K103004 from the Registry of Standard Biological Parts) | Staphylococcal protein A |
| RGD (BBa_K133059 from the Registry of Standard Biological Parts) | integrins |
| Cdc4 (found in yeast; comprises F-box domain) | Sic1 CDK inhibitor; Skp1, Rbx1 |
| Grr1 (found in yeast; comprises F-box domain) | Cyclin (CLN) 1, 2; Skp1, Rbx1 |
| TrCp (found in yeast; comprises F-box domain) | IkB(NFKB regulator); Skp1, Rbx1 |

V.3 Template Binding Domains that are Small Molecule-Binding Polypeptides

In some embodiments, the template binding domain is a protein, and the template binding domain partner is a small molecule. Generally, when the template binding domain has affinity for a small molecule, the small molecule is rare or absent in the cell being altered. This helps to avoid nonspecific binding.

In some embodiments, the template-binding domain carries one or more deletions or substitutions relative to the wild-type protein from which it was derived. For example, there may be a deletion of or substitution within a catalytic domain, a DNA-binding domain, a protein-protein interaction domain, and/or a domain necessary for transcriptional regulation.

Exemplary small molecule-binding domains are given in the table below. The template-binding domain may comprise one or more of these small molecule-binding domains or polypeptides derived therefrom.

TABLE V.7

Proteins that bind small molecules

| Protein | Small molecule |
| --- | --- |
| Avidin or Streptavidin (BBa K283010 from the Registry of Standard Biological Parts) | biotin |
| gyrEC (BBa_K133070 from the Registry of Standard Biological Parts) | coumermycin |
| RI7 (BBa K211001 from the Registry of Standard Biological Parts) | octanal, heptanal or hexanal |
| VirA receptor (BBa_K389001 from the Registry of Standard Biological Parts) | acetosyringone |
| Penicillin-binding proteins (PBPs), e.g., serine type D-alanyl-D-alanine carboxypeptidase/transpeptidase | penicillin or cephalosporin |
| TetR | tetracycline |
| ASGPR | N-Acetylgalactosamine or galactose |

VI. Template Binding Domain Partner

VI.1 Template binding domain partners that are nucleic acids

Double Stranded DNA

In some embodiments, the template binding domain partner is double-stranded DNA. For instance, in some embodiments, the template binding domain partner is double-stranded DNA that is recognized by a DNA-binding protein described above in Section V.1.

The template binding domain partner may be, e.g., identical to or derived from a DNA sequence that is bound by a protein in a wild-type context. In some embodiments, the template binding domain partner comprises all or part of a transcription factor binding site from an organism other than the organism of the cell being altered. In some embodiments, the template binding domain partner comprises all or part of a transcriptional regulation site from an operon, e.g., a bacterial operon.

In some embodiments, the template binding domain partner is at least 10 nucleotides long, e.g., at least 15, 20, 25, 30, 35, 40, 45, 50, 75, 100, 150, or 200 nucleotides long. In some embodiments, the template binding domain partner is at most 200 nucleotides long, e.g., at most 15, 20, 25, 30, 35, 40, 45, 50, 75, 100, 150, or 200 nucleotides long. In some embodiments, the template binding domain partner is 10-20, 20-30, 30-40, 40-50, 50-75, 75-100, 100-150, or 150-200 nucleotides long.

In some embodiments, the template binding domain partner comprises palindromic sequences.

In some embodiments, the template binding domain partner comprises a plurality of shorter sequences, wherein each shorter sequence is bound by a distinct DNA-binding domain. In some embodiments, the plurality of shorter sequences are identical, e.g., the template binding domain partner comprises repeats. In other embodiments, one or more of, e.g., all of the plurality of shorter sequences are not identical to each other.

In some embodiments, the template binding domain partner is chemically modified DNA, e.g., as set out in Section XI below. The modification may be, e.g., to one or more bases and/or to the backbone. The chemical modification may do one or more of the following: improve the stability of the DNA, reduce the innate immune response against the DNA, and improve the binding of the template binding domain to the template binding domain partner.

The template binding domain partner need not always be the same type of molecule as the template nucleic acid. For instance, in some embodiments, the template binding domain partner is double stranded, while the template nucleic acid is single stranded. In some such embodiments, a long single-stranded DNA comprises a hairpin at one end, and the double stranded region of the hairpin comprises the template binding domain partner. In other embodiments, the template binding domain partner and the template nucleic acid are both double stranded. In some embodiments, the template binding domain partner is derived from a wild-type template binding domain partner. For example, the template binding domain partner may be a fragment of a naturally occurring nucleic acid, a mutagenized nucleic acid, a synthetic nucleic acid modeled after a naturally-occurring nucleic acid. In some embodiments, the template binding domain partner is mutagenized to increase its affinity for a template binding domain. In some embodiments, the template binding domain partner is mutagenized to decrease its affinity for a template binding domain.

Single Stranded DNA

In some embodiments, the template binding domain partner is single-stranded DNA.

VI. 2 Template Binding Domain Partners that are Polypeptides

In some embodiments, the template binding domain partner is a polypeptide. Any of the proteins and/or polypeptides discussed above in Sections V, may be used in the present invention, as a template binding domain partner. For example, protein-protein interacting pairs are discussed above, e.g., in Table V.6.

VII. Functional Analysis of Candidate Molecules

Candidate Cas9 molecules, candidate Cas9 fusion molecules, candidate gRNA molecules, and candidate Cas9 fusion molecule/gRNA molecule complexes, can be evaluated by art-known methods or as described herein. For example, exemplary methods for evaluating the endonuclease activity of Cas9 fusion molecule are described, e.g., in Jinek et al. (2012) SCIENCE 337(6096): 816-821.

The methods in this section may be used, e.g., to test various portions of a gRNA, for example, the targeting domain, the first complementarity domain, the linking domain, the second complementarity domain, the proximal domain, or the tail domain. In some embodiments, the methods in this section are tested to determine whether modifications made in one or more of these domains interfere with targeting efficacy. A gRNA with a selected length, sequence, degree of complementarity, or degree of modification, can be evaluated in a system of this section.

Binding and Cleavage Assay: Testing the Endonuclease Activity of Cas9 Fusion Molecule The ability of a Cas9 fusion molecule/gRNA molecule complex to bind to and cleave a target nucleic acid can be evaluated in a plasmid cleavage assay. In this assay, synthetic or in vitro-transcribed gRNA molecule is pre-annealed prior to the reaction by heating to 95° C. and slowly cooling down to room temperature. Native or restriction digest-linearized plasmid DNA (300 ng (~8 nM)) is incubated for 60 min at 37° C. with purified Cas9 protein molecule (50-500 nM) and gRNA (50-500 nM, 1:1) in a Cas9 plasmid cleavage buffer (20 mM HEPES pH 7.5, 150 mM KCl, 0.5 mM DTT, 0.1 mM EDTA) with or without 10 mM $MgCl_2$. The reactions are stopped with 5×DNA loading buffer (30% glycerol, 1.2% SDS, 250 mM EDTA), resolved by a 0.8 or 1% agarose gel electrophoresis and visualized by ethidium bromide staining. The resulting cleavage products indicate whether the Cas9 molecule cleaves both DNA strands, or only one of the two strands. For example, linear DNA products indicate the cleavage of both DNA strands. Nicked open circular products indicate that only one of the two strands is cleaved.

Alternatively, the ability of a Cas9 fusion molecule/gRNA molecule complex to bind to and cleave a target nucleic acid can be evaluated in an oligonucleotide DNA cleavage assay. In this assay, DNA oligonucleotides (10 pmol) are radiolabeled by incubating with 5 units T4 polynucleotide kinase and ~3-6 pmol (~20-40 mCi) [γ-32P]-ATP in 1×T4 polynucleotide kinase reaction buffer at 37° C. for 30 min., in a 50 µL reaction. After heat inactivation (65° C. for 20 min), reactions are purified through a column to remove unincorporated label. Duplex substrates (100 nM) are generated by annealing labeled oligonucleotides with equimolar amounts of unlabeled complementary oligonucleotide at 95° C. for 3 min., followed by slow cooling to room temperature. For cleavage assays, gRNA molecules are annealed by heating to 95° C. for 30 s, followed by slow cooling to room temperature. Cas9 fusion molecule (500 nM final concentration) is pre-incubated with the annealed gRNA molecules (500 nM) in cleavage assay buffer (20 mM HEPES pH 7.5, 100 mM KCl, 5 mM $MgCl_2$, 1 mM DTT, 5% glycerol) in a total volume of 9 µl. Reactions are initiated by the addition of 1 µl target DNA (10 nM) and incubated for 1 h at 37° C. Reactions are quenched by the addition of 20 µl of loading dye (5 mM EDTA, 0.025% SDS, 5% glycerol in formamide) and heated to 95° C. for 5 min. Cleavage products are resolved on 12% denaturing polyacrylamide gels containing 7 M urea and visualized by phosphorimaging. The resulting cleavage products indicate that whether the complementary strand, the non-complementary strand, or both, are cleaved.

One or both of these assays can be used to evaluate the suitability of a candidate gRNA molecule, a candidate Cas9 molecule, or a candidate Cas9 fusion molecule.

Binding Assay: Testing the Binding of Cas9 Fusion Molecule to Target DNA

Exemplary methods for evaluating the binding of a Cas9 fusion molecule to target DNA are described, e.g., in Jinek et al. (2012) SCIENCE 337(6096):816-821.

For example, in an electrophoretic mobility shift assay, target DNA duplexes are formed by mixing of each strand (10 nmol) in deionized water, heating to 95° C. for 3 min. and slow cooling to room temperature. All DNAs are purified on 8% native gels containing 1×TBE. DNA bands are visualized by UV shadowing, excised, and eluted by soaking gel pieces in DEPC-treated H2O. Eluted DNA is ethanol precipitated and dissolved in DEPC-treated H2O. DNA samples are 5' end labeled with [γ-32P]-ATP using T4 polynucleotide kinase for 30 min. at 37° C. Polynucleotide kinase is heat denatured at 65° C. for 20 min., and unincorporated radiolabel is removed using a column. Binding assays are performed in buffer containing 20 mM HEPES pH 7.5, 100 mM KCl, 5 mM $MgCl_2$, 1 mM DTT and 10% glycerol in a total volume of 10 Cas9 fusion molecule is programmed with equimolar amounts of pre-annealed gRNA molecule and titrated from 100 pM to 1 μM. Radiolabeled DNA is added to a final concentration of 20 pM. Samples are incubated for 1 h at 37° C. and resolved at 4° C. on an 8% native polyacrylamide gel containing 1×TBE and 5 mM $MgCl_2$. Gels are dried and DNA visualized by phosphorimaging.

Differential Scanning Flourimetry (DSF)

The thermostability of Cas9 molecule-gRNA ribonucleoprotein (RNP) complexes, e.g., a Cas9 fusion molecule-gRNA RNP complex, can be measured via DSF. This technique measures the thermostability of a protein, which can increase under favorable conditions such as the addition of a binding RNA molecule, e.g., a gRNA.

The assay is performed using two different protocols, one to test the best stoichiometric ratio of gRNA:Cas9 protein and another to determine the best solution conditions for RNP formation.

To determine the best solution to form RNP complexes, a 2 uM solution of Cas9 in water+10×SYPRO Orange® (Life Technologies cat #S-6650) and dispensed into a 384 well plate. An equimolar amount of gRNA diluted in solutions with varied pH and salt is then added. After incubating at room temperature for 10 min. and brief centrifugation to remove any bubbles, a Bio-Rad CFX384™ Real-Time System C1000 Touch™ Thermal Cycler with the Bio-Rad CFX Manager software is used to run a gradient from 20° C. to 90° C. with a 1° C. increase in temperature every 10 seconds.

The second assay consists of mixing various concentrations of gRNA with 2 uM Cas9 molecule in optimal buffer from the assay above and incubating at RT for 10 min in a 384 well plate. An equal volume of optimal buffer+10× SYPRO Orange® (Life Techonologies cat #S-6650) is added and the plate sealed with Microseal® B adhesive (MSB-1001). Following brief centrifugation to remove any bubbles, a Bio-Rad CFX384™ Real-Time System C1000 Touch™ Thermal Cycler with the Bio-Rad CFX Manager software is used to run a gradient from 20° C. to 90° C. with a 1° increase in temperature every 10 seconds.

VIII. Genome Editing Approaches

Mutations may be corrected, and undesirable nucleic acid sequences may be cleaved, using one of the approaches discussed herein. In an embodiment, a mutation in a target nucleic acid is corrected by homology directed repair (HDR) using a template nucleic acid (see Section VIII.1).

VIII.1 HDR Repair and Template Nucleic Acids

As described herein, nuclease-induced homology directed repair (HDR) can be used to alter a target sequence and correct (e.g., repair or edit) a mutation in the genome. While not wishing to be bound by theory, it is believed that alteration of the target sequence occurs by homology-directed repair (HDR) with a donor template or template nucleic acid. For example, the donor template or the template nucleic acid provides for alteration of the target position. It is contemplated that a plasmid donor can be used as a template for homologous recombination. It is further contemplated that a single stranded donor template can be used as a template for alteration of the target position by alternate methods of homology directed repair (e.g., single strand annealing) between the target position and the donor template.

Donor template-effected alteration of a target position depends on cleavage by a Cas9 molecule. Cleavage by Cas9 can comprise a nick, a double strand break, or two single strand breaks, e.g., one on each strand of the target nucleic acid. In an embodiment, a mutation can be corrected by either a single double-strand break or two single strand breaks. In an embodiment, a mutation can be corrected by (1) a single double-strand break, (2) two single strand breaks, (3) two double stranded breaks with a break occurring on each side of the target position, (4) one double stranded break and two single strand breaks with the double strand break and two single strand breaks occurring on each side of the target position or (5) four single stranded breaks with a pair of single stranded breaks occurring on each side of the target position.

Additional details on template nucleic acids are provided in Section IV entitled "Template Nucleic Acids" in PCT Application WO 2015/048577, the entire contents of which are expressly incorporated herein by reference.

Double Strand Break Mediated Correction

In an embodiment, double strand cleavage is effected by a Cas9 molecule having cleavage activity associated with an HNH-like domain and cleavage activity associated with a RuvC-like domain, e.g., an N-terminal RuvC-like domain, e.g., a wild type Cas9 molecule. Such embodiments require only a single gRNA.

Single Strand Break Mediated Correction

In other embodiments, two single strand breaks, or nicks, are effected by a Cas9 molecule having nickase activity, e.g., cleavage activity associated with an HNH-like domain or cleavage activity associated with an N-terminal RuvC-like domain. Such embodiments usually require two gRNAs, one for placement of each single strand break. In an embodiment, the Cas9 molecule having nickase activity cleaves the strand to which the gRNA hybridizes, but not the strand that is complementary to the strand to which the gRNA hybridizes. In an embodiment, the Cas9 molecule having nickase activity does not cleave the strand to which the gRNA hybridizes, but rather cleaves the strand that is complementary to the strand to which the gRNA hybridizes.

In an embodiment, the nickase has HNH activity, e.g., a Cas9 molecule having the RuvC activity inactivated, e.g., a Cas9 molecule having a mutation at D10, e.g., the D10A mutation. D10A inactivates RuvC; therefore, the Cas9 nickase has (only) HNH activity and will cut on the strand to which the gRNA hybridizes (e.g., the complementary strand, which does not have the NGG PAM on it). In other embodiments, a Cas9 molecule having an H840, e.g., an H840A, mutation can be used as a nickase. H840A inactivates HNH; therefore, the Cas9 nickase has (only) RuvC activity and cuts on the non-complementary strand (e.g., the strand that has the NGG PAM and whose sequence is identical to the gRNA). In other embodiments, a Cas9 molecule having an N863, e.g., the N863A mutation, mutation can be used as a nickase. N863A inactivates HNH therefore the Cas9 nickase has (only) RuvC activity and cuts on the non-complementary strand (the strand that has the NGG PAM and whose sequence is identical to the gRNA). In other embodiments, a Cas9 molecule having an N580, e.g., the N580A mutation, mutation can be used as a nickase. N580A inactivates HNH therefore the Cas9 nickase has (only) RuvC activity and cuts on the non-complementary strand (the strand that has the NGG PAM and whose sequence is identical to the gRNA). In an embodiment, in which a nickase and two gRNAs are used to position two single strand nicks, one nick is on the +strand and one nick is on the −strand of the target nucleic acid. The PAMs can be outwardly facing. The gRNAs can be selected such that the gRNAs are separated by, from about 0-50, 0-100, or 0-200 nucleotides. In an embodiment, there is no overlap between the target sequences that are complementary to the targeting domains of the two gRNAs. In an embodiment, the gRNAs do not overlap and are separated by as much as 50, 100, or 200 nucleotides. In an embodiment, the use of two gRNAs can increase specificity, e.g., by decreasing off-target binding (Ran et al. 2013, CELL 154: 1380-1389).

In an embodiment, a single nick can be used to induce HDR. It is contemplated herein that a single nick can be used to increase the ratio of HR to NHEJ at a given cleavage site. In an embodiment, a single strand break is formed in the strand of the target nucleic acid to which the targeting domain of said gRNA is complementary. In another embodiment, a single strand break is formed in the strand of the target nucleic acid other than the strand to which the targeting domain of said gRNA is complementary.

Placement of the Double Strand or Single Strand Breaks Relative to the Target Position The double strand break or single strand break in one of the strands should be sufficiently close to target position such that an alteration is produced in the desired region, e.g., correction of a mutation occurs. In an embodiment, the distance is not more than 50, 100, 200, 300, 350 or 400 nucleotides. While not wishing to be bound by theory, in some embodiments, it is believed that the break should be sufficiently close to target position such that the target position is within the region that is subject to exonuclease-mediated removal during end resection. If the distance between the target position and a break is too great, the mutation or other sequence desired to be altered may not be included in the end resection and, therefore, may not be corrected, as donor sequence, either exogenously provided donor sequence or endogenous genomic donor sequence, in some embodiments is only used to correct sequence within the end resection region.

In an embodiment, the targeting domain is configured such that a cleavage event, e.g., a double strand or single strand break, is positioned within 1, 2, 3, 4, 5, 10, 15, 20, 25, 30, 35, 40, 45, 50, 60, 70, 80, 90, 100, 150 or 200 nucleotides of the region desired to be altered, e.g., a mutation. The break, e.g., a double strand or single strand break, can be positioned upstream or downstream of the region desired to be altered, e.g., a mutation. In some embodiments, a break is positioned within the region desired to be altered, e.g., within a region defined by at least two mutant nucleotides. In some embodiments, a break is positioned immediately adjacent to the region desired to be altered, e.g., immediately upstream or downstream of a mutation.

In an embodiment, a single strand break is accompanied by an additional single strand break, positioned by a second gRNA molecule, as discussed below. For example, the targeting domains bind configured such that a cleavage event, e.g., the two single strand breaks, are positioned within 1, 2, 3, 4, 5, 10, 15, 20, 25, 30, 35, 40, 45, 50, 60, 70, 80, 90, 100, 150 or 200 nucleotides of a target position. In an embodiment, the first and second gRNA molecules are configured such, that when guiding a Cas9 nickase, a single strand break will be accompanied by an additional single strand break, positioned by a second gRNA, sufficiently close to one another to result in alteration of the desired region. In an embodiment, the first and second gRNA molecules are configured such that a single strand break positioned by said second gRNA is within 10, 20, 30, 40, or 50 nucleotides of the break positioned by said first gRNA molecule, e.g., when the Cas9 is a nickase. In an embodiment, the two gRNA molecules are configured to position cuts at the same position, or within a few nucleotides of one another, on different strands, e.g., essentially mimicking a double strand break.

In an embodiment, in which a gRNA (unimolecular (or chimeric) or modular gRNA) and Cas9 fusion molecule induce a double strand break for the purpose of inducing HDR-mediated correction, the cleavage site is between 0-200 bp (e.g., 0-175, 0 to 150, 0 to 125, 0 to 100, 0 to 75, 0 to 50, 0 to 25, 25 to 200, 25 to 175, 25 to 150, 25 to 125, 25 to 100, 25 to 75, 25 to 50, 50 to 200, 50 to 175, 50 to 150, 50 to 125, 50 to 100, 50 to 75, 75 to 200, 75 to 175, 75 to 150, 75 to 125, 75 to 100 bp) away from the target position. In an embodiment, the cleavage site is between 0-100 bp (e.g., 0 to 75, 0 to 50, 0 to 25, 25 to 100, 25 to 75, 25 to 50, 50 to 100, 50 to 75 or 75 to 100 bp) away from the target position.

In an embodiment, the targeting domain of a gRNA molecule is configured to position a cleavage event sufficiently far from a preselected nucleotide, e.g., the nucleotide of a coding region, such that the nucleotide is not altered. In an embodiment, the targeting domain of a gRNA molecule is configured to position an intronic cleavage event sufficiently far from an intron/exon border, or naturally occurring splice signal, to avoid alteration of the exonic sequence or unwanted splicing events. The gRNA molecule may be a first, second, third and/or fourth gRNA molecule, as described herein.

Placement of a First Break and a Second Break Relative to Each Other

In an embodiment, a double strand break can be accompanied by an additional double strand break, positioned by a second gRNA molecule, as is discussed below.

In an embodiment, a double strand break can be accompanied by two additional single strand breaks, positioned by a second gRNA molecule and a third gRNA molecule.

In an embodiment, a first and second single strand breaks can be accompanied by two additional single strand breaks positioned by a third gRNA molecule and a fourth gRNA molecule.

When two or more gRNAs are used to position two or more cleavage events, e.g., double strand or single strand breaks, in a target nucleic acid, it is contemplated that the two or more cleavage events may be made by the same or different Cas9 molecules. For example, when two gRNAs are used to position two double stranded breaks, a single Cas9 molecule may be used to create both double stranded breaks. When two or more gRNAs are used to position two or more single stranded breaks (nicks), a single Cas9 nickase may be used to create the two or more nicks. When two or more gRNAs are used to position at least one double stranded break and at least one single stranded break, two Cas9 proteins may be used, e.g., one Cas9 nuclease and one Cas9 nickase. It is contemplated that when two or more Cas9 proteins are used that the two or more Cas9 proteins may be delivered sequentially to control specificity of a double stranded versus a single stranded break at the desired position in the target nucleic acid.

In some embodiments, the targeting domain of the first gRNA molecule and the targeting domain of the second gRNA molecules are complementary to opposite strands of the target nucleic acid molecule. In some embodiments, the gRNA molecule and the second gRNA molecule are configured such that the PAMs are oriented outward.

In an embodiment, in which two gRNAs (independently, unimolecular (or chimeric) or modular gRNA) complexing with Cas9 nickases induce two single strand breaks for the purpose of inducing HDR-mediated correction, the closer nick is between 0-200 bp (e.g., 0-175, 0 to 150, 0 to 125, 0 to 100, 0 to 75, 0 to 50, 0 to 25, 25 to 200, 25 to 175, 25 to 150, 25 to 125, 25 to 100, 25 to 75, 25 to 50, 50 to 200, 50 to 175, 50 to 150, 50 to 125, 50 to 100, 50 to 75, 75 to 200, 75 to 175, 75 to 150, 75 to 125, 75 to 100 bp) away from the target position and the two nicks will ideally be within 25-65 bp of each other (e.g., 25 to 50, 25 to 45, 25 to 40, 25 to 35, 25 to 30, 30 to 55, 30 to 50, 30 to 45, 30 to 40, 30 to 35, 35 to 55, 35 to 50, 35 to 45, 35 to 40, 40 to 55, 40 to 50, 40 to 45 bp, 45 to 50 bp, 50 to 55 bp, 55 to 60 bp, 60 to 65 bp) and no more than 100 bp away from each other (e.g., no more than 90, 80, 70, 60, 50, 40, 30, 20, 10 or 5 bp away from each other). In an embodiment, the cleavage site is between 0-100 bp (e.g., 0 to 75, 0 to 50, 0 to 25, 25 to 100, 25 to 75, 25 to 50, 50 to 100, 50 to 75 or 75 to 100 bp) away from the target position.

In one embodiment, two gRNAs, e.g., independently, unimolecular (or chimeric) or modular gRNA, are configured to position a double-strand break on both sides of a target position. In an alternate embodiment, three gRNAs, e.g., independently, unimolecular (or chimeric) or modular gRNA, are configured to position a double strand break (i.e., one gRNA complexes with a Cas9 nuclease) and two single strand breaks or paired single stranded breaks (i.e., two gRNAs complex with Cas9 nickases) on either side of the target position. In another embodiment, four gRNAs, e.g., independently, unimolecular (or chimeric) or modular gRNA, are configured to generate two pairs of single stranded breaks (i.e., two pairs of two gRNAs complex with Cas9 nickases) on either side of the target position. The double strand break(s) or the closer of the two single strand nicks in a pair will ideally be within 0-500 bp of the target position (e.g., no more than 450, 400, 350, 300, 250, 200, 150, 100, 50 or 25 bp from the target position). When nickases are used, the two nicks in a pair are, in some embodiments, within 25-65 bp of each other (e.g., between 25 to 55, 25 to 45, 25 to 40, 25 to 35, 25 to 30, 50 to 55, 45 to 55, 40 to 55, 35 to 55, 30 to 55, 30 to 50, 35 to 50, 40 to 50, 45 to 50, 35 to 45, 40 to 45 bp, 45 to 50 bp, 50 to 55 bp, 55 to 60 bp, or 60 to 65 bp) and no more than 100 bp away from each other (e.g., no more than 90, 80, 70, 60, 50, 40, 30, 20 or 10 bp). When two gRNAs are used to target Cas9 molecules to breaks, different combinations of Cas9 molecules are envisioned. In some embodiments, a first gRNA is used to target a first Cas9 molecule to a first target position, and a second gRNA is used to target a second Cas9 molecule to a second target position. In some embodiments, the first Cas9 molecule creates a nick on the first strand of the target nucleic acid, and the second Cas9 molecule creates a nick on the opposite strand, resulting in a double stranded break (e.g., a blunt ended cut or a cut with overhangs).

Different combinations of nickases can be chosen to target one single stranded break to one strand and a second single stranded break to the opposite strand. When choosing a combination, one can take into account that there are nickases having one active RuvC-like domain, and nickases having one active HNH domain. In an embodiment, a RuvC-like domain cleaves the non-complementary strand of the target nucleic acid molecule. In an embodiment, an HNH-like domain cleaves a single stranded complementary domain, e.g., a complementary strand of a double stranded nucleic acid molecule. Generally, if both Cas9 molecules have the same active domain (e.g., both have an active RuvC domain or both have an active HNH domain), one will choose two gRNAs that bind to opposite strands of the target. In more detail, in some embodiments, a first gRNA is complementary with a first strand of the target nucleic acid and binds a nickase having an active RuvC-like domain and causes that nickase to cleave the strand that is non-complementary to that first gRNA, i.e., a second strand of the target nucleic acid; and a second gRNA is complementary with a second strand of the target nucleic acid and binds a nickase having an active RuvC-like domain and causes that nickase to cleave the strand that is non-complementary to that second gRNA, i.e., the first strand of the target nucleic acid. Conversely, in some embodiments, a first gRNA is complementary with a first strand of the target nucleic acid and binds a nickase having an active HNH domain and causes that nickase to cleave the strand that is complementary to that first gRNA, i.e., a first strand of the target nucleic acid; and a second gRNA is complementary with a second strand of the target nucleic acid and binds a nickase having an active HNH domain and causes that nickase to cleave the strand that is complementary to that second gRNA, i.e., the second strand of the target nucleic acid. In another arrangement, if one Cas9 molecule has an active RuvC-like domain and the other Cas9 molecule has an active HNH domain, the gRNAs for both Cas9 molecules can be complementary to the same strand of the target nucleic acid, so that the Cas9 molecule with the active RuvC-like domain will cleave the non-complementary strand and the Cas9 molecule with the HNH domain will cleave the complementary strand, resulting in a double stranded break.

Exemplary Template Nucleic Acids

A template nucleic acid, as that term is used herein, refers to a nucleic acid sequence which can be used in conjunction with a Cas9 fusion molecule and a gRNA molecule to alter the structure of a target position.

Target position, as used herein, refers to a site on a target nucleic acid (e.g., the chromosome) that is modified by a Cas9 molecule-dependent process, e.g., a Cas9 fusion molecule-dependent process. For example, the target position can be a modified Cas9 fusion molecule cleavage of the target nucleic acid and template nucleic acid directed modification, e.g., correction, of the target position. In an embodiment, a target position can be a site between two nucleotides, e.g., adjacent nucleotides, on the target nucleic acid into which one or more nucleotides are added. The target position may comprise one or more nucleotides that are altered, e.g., corrected, by a template nucleic acid. In an embodiment, the target position is within a target sequence (e.g., the sequence to which the gRNA binds). In an embodiment, a target position is upstream or downstream of a target sequence (e.g., the sequence to which the gRNA binds).

In an embodiment, the target nucleic acid is modified to have the some or all of the sequence of the template nucleic acid, typically at or near cleavage site(s). In an embodiment, the template nucleic acid is single stranded. In an alternate embodiment, the template nucleic acid is double stranded. In an embodiment, the template nucleic acid is DNA, e.g., double stranded DNA. In an alternate embodiment, the template nucleic acid is single stranded DNA. In an embodiment, the template nucleic acid is encoded on the same vector backbone, e.g., AAV genome or plasmid DNA, as the Cas9 fusion molecule and gRNA. In an embodiment, the template nucleic acid is excised from a vector backbone in vivo, e.g., it is flanked by gRNA recognition sequences. In an embodiment, the template nucleic acid comprises endogenous genomic sequence.

In an embodiment, the template nucleic acid alters the structure of the target position by participating in a homology directed repair event. In an embodiment, the template nucleic acid alters the sequence of the target position. In an embodiment, the template nucleic acid results in the incorporation of a modified, or non-naturally occurring base into the target nucleic acid.

Typically, the template sequence undergoes a breakage mediated or catalyzed recombination with the target sequence. In an embodiment, the template nucleic acid includes sequence that corresponds to a site on the target sequence that is cleaved by an eaCas9 mediated cleavage event. In an embodiment, the template nucleic acid includes sequence that corresponds to both, a first site on the target sequence that is cleaved in a first Cas9 mediated event, and a second site on the target sequence that is cleaved in a second Cas9 mediated event.

In an embodiment, the template nucleic acid can include sequence which results in an alteration in the coding sequence of a translated sequence, e.g., one which results in the substitution of one amino acid for another in a protein product, e.g., transforming a mutant allele into a wild type allele, transforming a wild type allele into a mutant allele, and/or introducing a stop codon, insertion of an amino acid residue, deletion of an amino acid residue, or a nonsense mutation.

In other embodiments, the template nucleic acid can include sequence which results in an alteration in a non-coding sequence, e.g., an alteration in an exon or in a 5' or 3' non-translated or non-transcribed region. Such alterations include an alteration in a control element, e.g., a promoter, enhancer, and an alteration in a cis-acting or trans-acting control element.

A template nucleic acid having homology with a target position in a gene, e.g., a gene described herein, can be used to alter the structure of a target sequence. The template sequence can be used to alter an unwanted structure, e.g., an unwanted or mutant nucleotide.

In an embodiment, the template nucleic acid is a single stranded nucleic acid. In another embodiment, the template nucleic acid is a double stranded nucleic acid. In some embodiments, the template nucleic acid comprises a nucleotide sequence, e.g., of one or more nucleotides, that will be added to or will template a change in the target nucleic acid. In other embodiments, the template nucleic acid comprises a nucleotide sequence that may be used to modify the target position. In other embodiments, the template nucleic acid comprises a nucleotide sequence, e.g., of one or more nucleotides, that corresponds to wild type sequence of the target nucleic acid, e.g., of the target position.

The template nucleic acid may comprise a replacement sequence. In some embodiments, the template nucleic acid comprises a 5' homology arm. In other embodiments, the template nucleic acid comprises a 3' homology arm.

In some embodiments, the template nucleic acid is linear double stranded DNA. The length may be, e.g., about 50-500 base pairs. The length may be, e.g., about 150-200 base pairs, e.g., about 150, 160, 170, 180, 190, or 200 base pairs. The length may be, e.g., at least 150, 160, 170, 180, 190, or 200 base pairs. In some embodiments, the length is no greater than 150, 160, 170, 180, 190, or 200 base pairs. In some embodiments, a double stranded template nucleic acid has a length of about 160 base pairs, e.g., about 155-165, 150-170, 140-180, 130-190, 120-200, 110-210, 100-220, 90-230, or 80-240 base pairs.

The template nucleic acid can be linear single stranded DNA. In some embodiments, the template nucleic acid is (i) linear single stranded DNA that can anneal to the nicked strand of the target nucleic acid, (ii) linear single stranded DNA that can anneal to the intact strand of the target nucleic acid, (iii) linear single stranded DNA that can anneal to the transcribed strand of the target nucleic acid, (iv) linear single stranded DNA that can anneal to the non-transcribed strand of the target nucleic acid, or more than one of the preceding. The length may be, e.g., 50-500 nucleotides. The length may be, e.g., about 50-500 nucleotides. The length may be, e.g., about 150-200 nucleotides, e.g., about 150, 160, 170, 180, 190, or 200 nucleotides. The length may be, e.g., at least 150, 160, 170, 180, 190, or 200 nucleotides. In some embodiments, the length is no greater than 150, 160, 170, 180, 190, or 200 nucleotides. In some embodiments, a single stranded template nucleic acid has a length of about 160 nucleotides, e.g., about 155-165, 150-170, 140-180, 130-190, 120-200, 110-210, 100-220, 90-230, or 80-240 nucleotides.

In some embodiments, the template nucleic acid is circular double stranded DNA, e.g., a plasmid. In some embodiments, the template nucleic acid comprises about 500 to 1000 base pairs of homology on either side of the replacement sequence and/or the nick. In some embodiments, the template nucleic acid comprises about 300, 400, 500, 600, 700, 800, 900, 1000, 1500, or 2000 base pairs of homology 5' of the nick or replacement sequence, 3' of the nick or replacement sequence, or both 5' and 3' of the nick or replacement sequence. In some embodiments, the template nucleic acid comprises at least 300, 400, 500, 600, 700, 800, 900, 1000, 1500, or 2000 base pairs of homology 5' of the nick or replacement sequence, 3' of the nick or replacement sequence, or both 5' and 3' of the nick or replacement sequence. In some embodiments, the template nucleic acid comprises no more than 300, 400, 500, 600, 700, 800, 900, 1000, 1500, or 2000 base pairs of homology 5' of the nick or replacement sequence, 3' of the nick or replacement sequence, or both 5' and 3' of the nick or replacement sequence.

In some embodiments, the template nucleic acid is an adenovirus vector, e.g., an AAV vector, e.g., a ssDNA molecule of a length and sequence that allows it to be packaged in an AAV capsid. The vector may be, e.g., less than 5 kb and may contain an ITR sequence that promotes packaging into the capsid. The vector may be integration-deficient. In some embodiments, the template nucleic acid comprises about 150 to 1000 nucleotides of homology on either side of the replacement sequence and/or the nick. In some embodiments, the template nucleic acid comprises about 100, 150, 200, 300, 400, 500, 600, 700, 800, 900, 1000, 1500, or 2000 nucleotides 5' of the nick or replacement sequence, 3' of the nick or replacement sequence, or both 5' and 3' of the nick or replacement sequence. In some embodiments, the template nucleic acid comprises at least 100, 150, 200, 300, 400, 500, 600, 700, 800, 900, 1000, 1500, or 2000 nucleotides 5' of the nick or replacement sequence, 3' of the nick or replacement sequence, or both 5' and 3' of the nick or replacement sequence. In some embodiments, the template nucleic acid comprises at most 100, 150, 200, 300, 400, 500, 600, 700, 800, 900, 1000, 1500, or 2000 nucleotides 5' of the nick or replacement sequence, 3' of the nick or replacement sequence, or both 5' and 3' of the nick or replacement sequence.

In some embodiments, the template nucleic acid is a lentiviral vector, e.g., an IDLV (integration deficiency lentivirus). In some embodiments, the template nucleic acid comprises about 500 to 1000 base pairs of homology on either side of the replacement sequence and/or the nick. In some embodiments, the template nucleic acid comprises about 300, 400, 500, 600, 700, 800, 900, 1000, 1500, or 2000 base pairs of homology 5' of the nick or replacement sequence, 3' of the nick or replacement sequence, or both 5' and 3' of the nick or replacement sequence. In some embodiments, the template nucleic acid comprises at least 300, 400, 500, 600, 700, 800, 900, 1000, 1500, or 2000 base pairs of homology 5' of the nick or replacement sequence, 3' of the nick or replacement sequence, or both 5' and 3' of the nick or replacement sequence. In some embodiments, the template nucleic acid comprises no more than 300, 400, 500, 600, 700, 800, 900, 1000, 1500, or 2000 base pairs of homology 5' of the nick or replacement sequence, 3' of the nick or replacement sequence, or both 5' and 3' of the nick or replacement sequence.

In an embodiment, the template nucleic acid comprises one or more mutations, e.g., silent mutations, that prevent Cas9 from recognizing and cleaving the template nucleic acid. The template nucleic acid may comprise, e.g., at least 1, 2, 3, 4, 5, 10, 20, or 30 silent mutations relative to the corresponding sequence in the genome of the cell to be altered. In an embodiment, the template nucleic acid comprises at most 2, 3, 4, 5, 10, 20, 30, or 50 silent mutations relative to the corresponding sequence in the genome of the cell to be altered.

In an embodiment, the template nucleic acid alters the structure of the target position by participating in a homology directed repair event. In an embodiment, the template nucleic acid alters the sequence of the target position. In an embodiment, the template nucleic acid results in the incorporation of a modified, or non-naturally occurring base into the target nucleic acid.

Typically, the template sequence undergoes a breakage mediated or catalyzed recombination with the target sequence. In an embodiment, the template nucleic acid includes sequence that corresponds to a site on the target sequence that is cleaved by an eaCas9 mediated cleavage event. In an embodiment, the template nucleic acid includes sequence that corresponds to both, a first site on the target sequence that is cleaved in a first Cas9 mediated event, and a second site on the target sequence that is cleaved in a second Cas9 mediated event.

In an embodiment, the template nucleic acid can include sequence which results in an alteration in the coding sequence of a translated sequence, e.g., one which results in the substitution of one amino acid for another in a protein product, e.g., transforming a mutant allele into a wild type allele, transforming a wild type allele into a mutant allele, and/or introducing a stop codon, insertion of an amino acid residue, deletion of an amino acid residue, or a nonsense mutation. In an embodiment, the template nucleic acid can include sequence which results in an alteration in a coding sequence, e.g., an alteration in an exon.

In other embodiments, the template nucleic acid can include sequence which results in an alteration in a non-coding sequence, e.g., an alteration in an intron or in a 5' or 3' non-translated or non-transcribed region. Such alterations include an alteration in a control element, e.g., a promoter, enhancer, and an alteration in a cis-acting or trans-acting control element.

A template nucleic acid having homology with a target position can be used to alter the structure of a target sequence. The template sequence can be used to alter an unwanted structure, e.g., an unwanted or mutant nucleotide.

Length of the Homology Arms

The homology arm should extend at least as far as the region in which end resection may occur, e.g., in order to allow the resected single stranded overhang to find a complementary region within the donor template. The overall length could be limited by parameters such as plasmid size or viral packaging limits. In an embodiment, a homology arm does not extend into repeated elements, e.g., ALU elements or LINE elements.

Exemplary homology arm lengths include a least 50, 100, 250, 500, 750, 1000, 2000, 3000, 4000, or 5000 nucleotides. In some embodiments, the homology arm length is 50-100, 100-250, 250-500, 500-750, 750-1000, 1000-2000, 2000-3000, 3000-4000, or 4000-5000 nucleotides.

A template nucleic acid typically comprises the following components:

[5' homology arm]-[replacement sequence]-[3' homology arm].

The homology arms provide for recombination into the chromosome, thus replacing the undesired element, e.g., a mutation or signature, with the replacement sequence. In an embodiment, the homology arms flank the most distal cleavage sites.

In an embodiment, the 3' end of the 5' homology arm is the position next to the 5' end of the replacement sequence. In an embodiment, the 5' homology arm can extend at least 10, 20, 30, 40, 50, 100, 200, 300, 400, 500, 600, 700, 800, 900, 1000, 1500, 2000, 3000, 4000, or 5000 nucleotides 5' from the 5' end of the replacement sequence.

In an embodiment, the 5' end of the 3' homology arm is the position next to the 3' end of the replacement sequence. In an embodiment, the 3' homology arm can extend at least 10, 20, 30, 40, 50, 100, 200, 300, 400, 500, 600, 700, 800, 900, 1000, 1500, 2000, 3000, 4000, or 5000 nucleotides 3' from the 3' end of the replacement sequence.

In an embodiment, to correct a mutation, the homology arms, e.g., the 5' and 3' homology arms, may each comprise about 1000 base pairs (bp) of sequence flanking the most distal gRNAs (e.g., 1000 bp of sequence on either side of the mutation).

It is contemplated herein that one or both homology arms may be shortened to avoid including certain sequence repeat elements, e.g., Alu element or LINE elements. For example, a 5' homology arm may be shortened to avoid a sequence repeat element. In other embodiments, a 3' homology arm may be shortened to avoid a sequence repeat element. In some embodiments, both the 5' and the 3' homology arms may be shortened to avoid including certain sequence repeat elements.

It is contemplated herein that template nucleic acids for correcting a mutation may be designed for use as a single-stranded oligonucleotide, e.g., a single-stranded oligodeoxynucleotide (ssODN). When using a ssODN, 5' and 3' homology arms may range up to about 200 base pairs (bp) in length, e.g., at least 25, 50, 75, 100, 125, 150, 175, or 200 bp in length. Longer homology arms are also contemplated for ssODNs as improvements in oligonucleotide synthesis continue to be made. In some embodiments, a longer homology arm is made by a method other than chemical synthesis, e.g., by denaturing a long double stranded nucleic acid and purifying one of the strands, e.g., by affinity for a strand-specific sequence anchored to a solid substrate.

Exemplary Arrangements of Linear Nucleic Acid Template Systems

In an embodiment, the nucleic acid template system is double stranded. In an embodiment, the nucleic acid template system is single stranded. In an embodiment, the nucleic acid template system comprises a single stranded portion and a double stranded portion. For example, the template binding domain partner is double stranded and the template nucleic acid is single stranded.

In an embodiment, the template nucleic acid comprises about 50 to 500 base pairs. In an embodiment, the template nucleic acid comprises about 50 to 100, e.g., 55 to 95, 60 to 90, 65 to 85, or 70 to 80, base pairs, homology on either side of the nick and/or replacement sequence. In an embodiment, the template nucleic acid comprises about 50, 55, 60, 65, 70, 75, 80, 85, 90, 95, or 100 base pairs homology 5' of the nick or replacement sequence, 3' of the nick or replacement sequence, or both 5' and 3' of the nick or replacement sequences.

In an embodiment, the template nucleic acid comprises about 150 to 200, e.g., 155 to 195, 160 to 190, 165 to 185, or 170 to 180, base pairs homology 3' of the nick and/or replacement sequence. In an embodiment, the template nucleic acid comprises about 150, 155, 160, 165, 170, 175, 180, 185, 190, 195, or 200 base pairs homology 3' of the nick or replacement sequence. In an embodiment, the template nucleic acid comprises less than about 100, 90, 80, 70, 60, 50, 40, 30, 20, 15, or 10 base pairs homology 5' of the nick or replacement sequence.

In an embodiment, the template nucleic acid comprises about 150 to 200, e.g., 155 to 195, 160 to 190, 165 to 185, or 170 to 180, base pairs homology 5' of the nick and/or replacement sequence. In an embodiment, the template nucleic acid comprises about 150, 155, 160, 165, 170, 175, 180, 185, 190, 195, or 200 base pairs homology 5' of the nick or replacement sequence. In an embodiment, the template nucleic acid comprises less than about 100, 90, 80, 70, 60, 50, 40, 30, 20, 15, or 10 base pairs homology 3' of the nick or replacement sequence.

Figure 1:
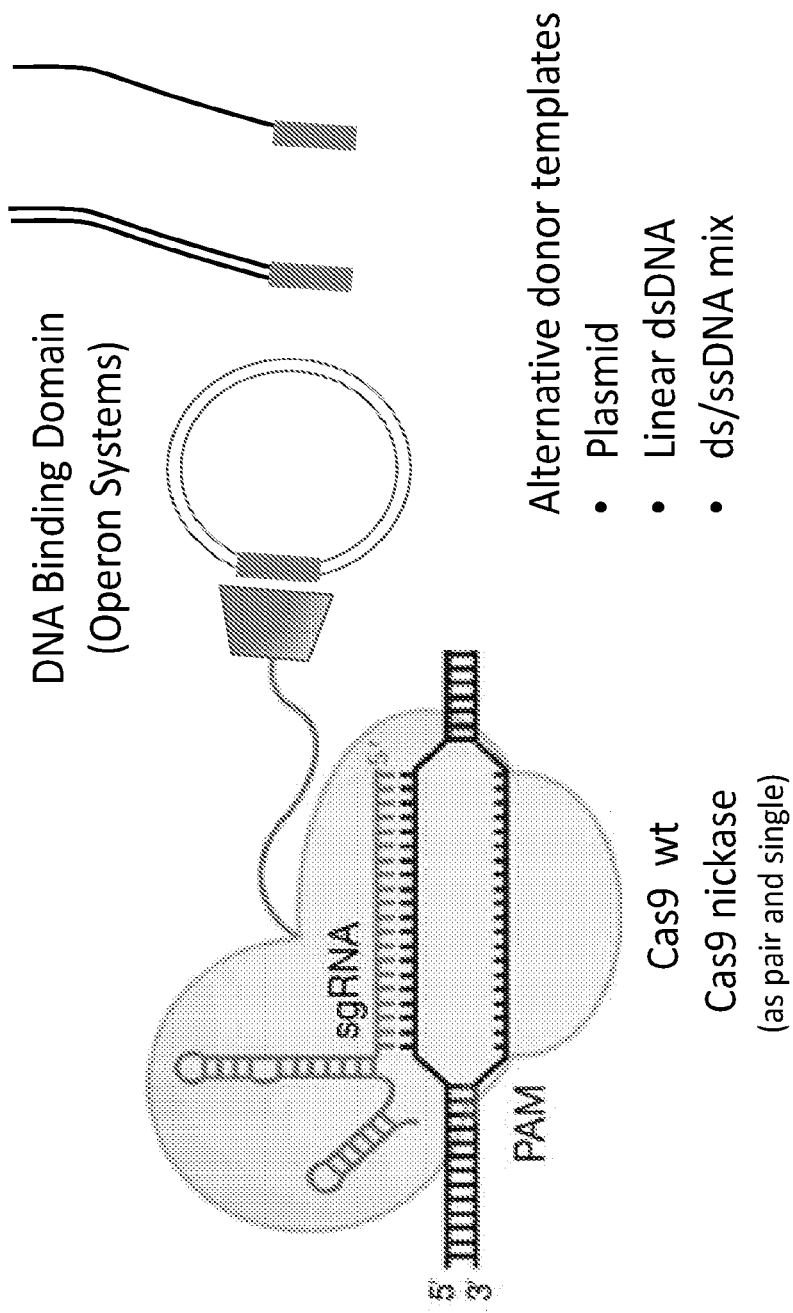
FIG. 1 illustrates embodiments where a Cas9 molecule is engineered to selectively associate with a template nucleic acid, and therefore increase the proximity of the template nucleic acid to a target nucleic acid. The Cas9 molecule (which can be, e.g., wild-type or a nickase) is shown associated with a target nucleic acid, e.g., a mutant gene. The Cas9 molecule is associated with a gRNA that targets the Cas9 molecule to the target nucleic acid. The target nucleic acid comprises a target sequence which is recognized by a gRNA, as well as a PAM sequence that is recognized by the Cas9 molecule. The Cas9 molecule is shown linked to a template binding domain (illustrated as a trapezoid) using a linker region (illustrated as a line connecting the Cas9 molecule and the template binding domain). The template binding domain (which can be a DNA binding domain) has affinity for a template binding domain partner (which can be a DNA sequence specifically recognized by the DNA binding domain) which is shown as a shaded rectangle. In this figure, the template binding domain partner is part of a circular double stranded nucleic acid molecule. The circular nucleic acid molecule also comprises a template nucleic acid which is capable of participating in homology-dependent repair of a break in the target nucleic acid. Together, the template nucleic acid and the template binding domain partner form a nucleic acid template system. The figure also shows alternative nucleic acid template systems, one which is a double stranded linear nucleic acid, and one which is a single stranded linear nucleic acid.
Figure 2:
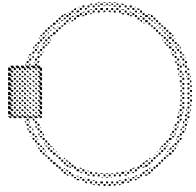
FIG. 2 depicts exemplary nucleic acid template systems. The template binding domain partner (e.g., a stretch of DNA that a DNA-binding domain can bind) is shown as a shaded box. The template nucleic acid is illustrated as a single line which represents single-stranded DNA, or a double line which represents double stranded DNA. The figure illustrates that the template nucleic acid system can be a circular double stranded DNA molecule like a plasmid; a linear double stranded DNA molecule, or a linear DNA molecule that is single stranded in the template nucleic acid region and double stranded in the template binding domain partner region. When the DNA is linear, the template binding domain partner can be, e.g., on either end of the molecule.
Figure 2:
Figure 2:
Figure 3:
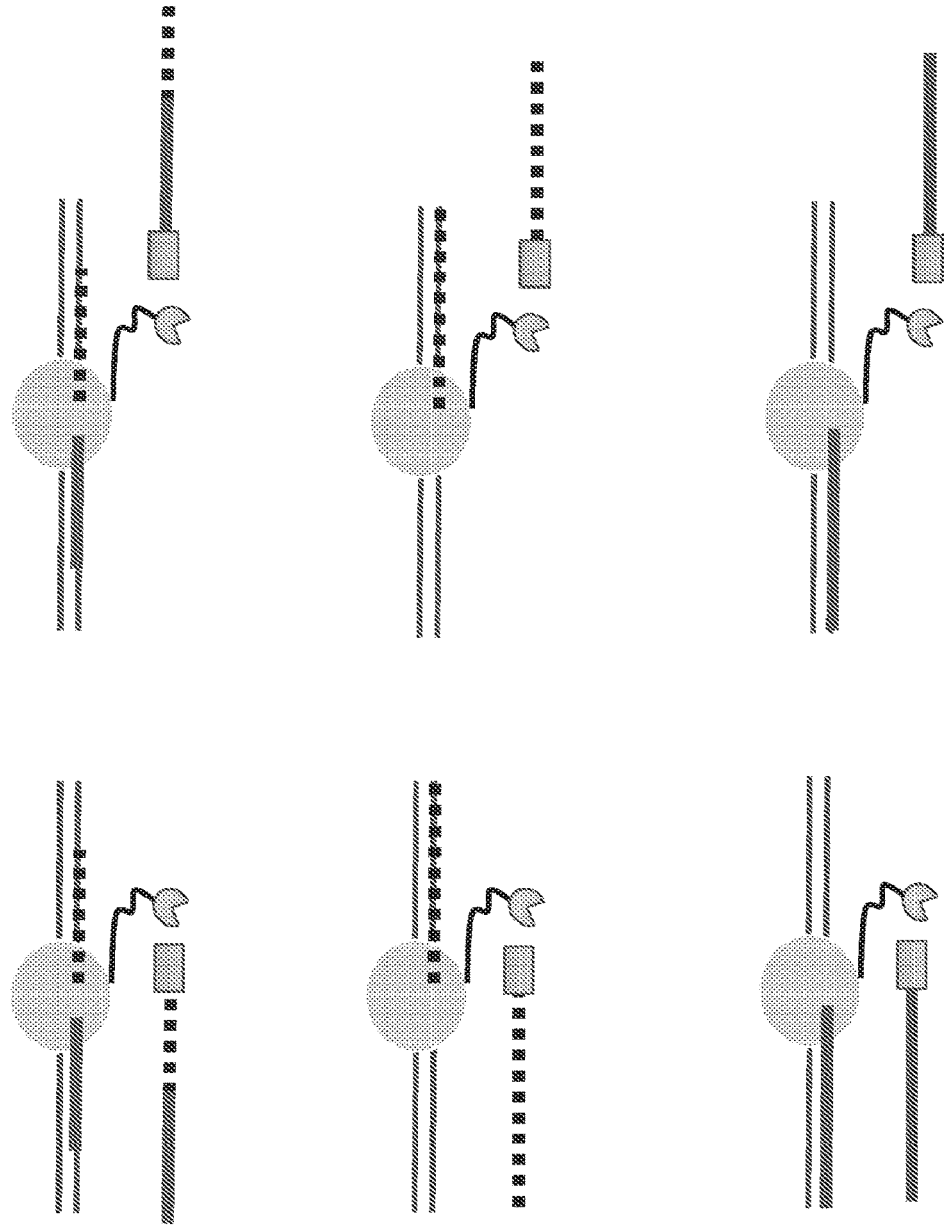
FIG. 3 depicts exemplary arrangements of linear nucleic acid template systems. The target nucleic acid (a long double stranded DNA segment like a gene or chromosome) is depicted as a double stranded shaded line with a break. The regions of the target nucleic acid that are homologous to a template nucleic acid are shown as thick solid or dotted lines. The Cas9 molecule is depicted as a shaded circle positioned over the break, and the template binding domain extends from the Cas9 molecule. The nucleic acid template systems are shown below the target nucleic acids, with the template binding domain partner shown as a shaded box and the template nucleic acid as a dotted or solid line. In this figure, the nucleic acid template system can be double stranded, single stranded, or have a single stranded portion and a double stranded portion (e.g., where the template binding domain partner is double stranded and the template nucleic acid is single stranded). The top row shows embodiments where the template nucleic acid has homology on either side of the cut, e.g., approximately 50 to 100 bp or nucleotides both on the left and on the right side of the cut.

In an embodiment, the 5' of the homology region is the position next or adjacent (e.g., within 10, 20, 30, 40, or 50 base pairs) to the 3' of the template binding domain partner. In an embodiment, the 3' of the homology region is the position next or adjacent (e.g., within 10, 20, 30, 40, or 50 base pairs) to the 5' of the template binding domain partner. For example, the template binding domain partner can be placed at the right of the nucleic acid template system, or at the left of the nucleic acid template system, as shown in FIG. 3.

Exemplary Arrangements of Circular Nucleic Acid Template Systems

In an embodiment, the nucleic acid template system is double stranded. In an embodiment, the nucleic acid template system is double stranded comprises a single stranded portion and a double stranded portion. In an embodiment, the nucleic acid template system is single stranded.

In an embodiment, the template nucleic acid comprises about 500 to 2000, e.g., 700 to 1900, 800 to 1800, 900 to 1700, 900 to 1600, 1000 to 1500, 1100 to 1400, or 1200 to 1300 base pairs, homology on either side of the nick and/or replacement sequence. In an embodiment, the template nucleic acid comprises about 500, 600, 700, 800, 900, 1000, 1100, 1200, 1300, 1400, 1500, 1600, 1700, 1800, 1900, or 2000 base pairs homology 5' of the nick or replacement sequence, 3' of the nick or replacement sequence, or both 5' and 3' of the nick or replacement sequences.

In an embodiment, the template nucleic acid comprises about 500 to 2000, e.g., 700 to 1900, 800 to 1800, 900 to 1700, 900 to 1600, 1000 to 1500, 1100 to 1400, or 1200 to 1300, base pairs homology 3' of the nick and/or replacement sequence. In an embodiment, the template nucleic acid comprises about 500, 600, 700, 800, 900, 1000, 1100, 1200, 1300, 1400, 1500, 1600, 1700, 1800, 1900, or 2000 base pairs homology 3' of the nick or replacement sequence. In an embodiment, the template nucleic acid comprises less than about 500, 400, 300, 200, 100, or 50 base pairs homology 5' of the nick or replacement sequence.

In an embodiment, the template nucleic acid comprises about 500 to 2000, e.g., 700 to 1900, 800 to 1800, 900 to 1700, 900 to 1600, 1000 to 1500, 1100 to 1400, or 1200 to 1300, base pairs homology 5' of the nick and/or replacement sequence. In an embodiment, the template nucleic acid comprises about 500, 600, 700, 800, 900, 1000, 1100, 1200, 1300, 1400, 1500, 1600, 1700, 1800, 1900, or 2000 base pairs homology 5' of the nick or replacement sequence. In an embodiment, the template nucleic acid comprises less than about 500, 400, 300, 200, 100, or 50 base pairs homology 3' of the nick or replacement sequence.

In an embodiment, the 5' of the homology region is the position next or adjacent (e.g., within 10, 20, 30, 40, or 50 base pairs) to the 3' of the template binding domain partner. In an embodiment, the 3' of the homology region is the position next or adjacent (e.g., within 10, 20, 30, 40, or 50 base pairs) to the 5' of the template binding domain partner. In an embodiment, the 5' of the homology region is the position at least 100, 250, 500, 1000, 1500, 2000, or 2500 base pairs downstream from the 3' of the template binding domain partner. In an embodiment, the 3' of the homology region is the position at least 100, 250, 500, 1000, 1500, 2000, or 2500 base pairs upstream from the 5' of the template binding domain partner.

In an embodiment, the 5' of the homology region is the position next or adjacent (e.g., within 10, 20, 30, 40, or 50 base pairs) to the 3' of the template binding domain partner, and the 3' of the homology region is the position at least 100, 250, 500, 1000, 1500, 2000, or 2500 base pairs upstream from the 5' of the template binding domain partner. In an embodiment, the 3' of the homology region is the position next or adjacent (e.g., within 10, 20, 30, 40, or 50 base pairs) to the 5' of the template binding domain partner, and the 5' of the homology region is the position at least 100, 250, 500, 1000, 1500, 2000, or 2500 base pairs downstream from the 3' of the template binding domain partner.

In an embodiment, the 5' of the homology region is the position at least 100, 250, 500, 1000, 1500, 2000, or 2500 base pairs downstream from the 3' of the template binding domain partner, and the 3' of the homology region is the position at least 100, 250, 500, 1000, 1500, 2000, or 2500 base pairs upstream from the 5' of the template binding domain partner.

For example, the template nucleic acid can comprise a homology region to the right of the template binding domain partner, to the left of the template binding domain partner, or on the opposite side of the circular nucleic acid molecule from the template binding domain partner, as shown in FIG. 4.

Methods of Promoting Break Repair by an HDR Pathway

In another aspect, disclosed herein is a method of altering a cell, e.g., altering the structure, e.g., altering the sequence, of a target nucleic acid of a cell, comprising contacting the cell with: (a) a gRNA that targets a target position, e.g., a gRNA as described herein; (b) a Cas9 molecule, e.g., a Cas9 fusion molecule as described herein; (c) a template nucleic acid, (d) a template binding domain, and (e) a template binding domain partner.

In some embodiments, the method comprises contacting the cell with (a) and (b), or with (a) and (c), or with (a) and (d), or with (a) and (e), or with (b) and (c), or with (b) and (d), or with (b) and (e), or with (c) and (d), or with (c) and (e), or with (d) and (e).

In some embodiments, the method comprises contacting the cell with (a), (b), and (c); with (a), (b), and (d); with (a), (b), and (e); with (b), (c), and (d); or with (b), (c), and (e); with (c), (d), and (e).

In some embodiments, the method comprises contacting said cell with (a), (b), (c) and (d); with (a), (b), (c), and (e); with (a), (b), (d), and (e); with (a), (c), (d), and (e); or with (b), (c), (d), and (e).

The contacting may be performed ex vivo and the contacted cell may be returned to the subject's body after the contacting step. In other embodiments, the contacting step may be performed in vivo.

In some embodiments, contacting a cell with a Cas9 fusion molecule comprises contacting the cell with a nucleic acid encoding the Cas9 fusion molecule and allowing the cell to produce the Cas9 fusion molecule. In some embodiments, contacting a cell with a gRNA comprises contacting the cell with DNA that can direct transcription of the gRNA, and allowing the cell to produce the gRNA.

In some embodiments, the method of altering a cell as described herein comprises acquiring knowledge of the presence of an undesired sequence in said cell, prior to the contacting step. Acquiring knowledge of the sequence of the undesired sequence in the cell may be by DNA sequencing.

In some embodiments, the contacting step of the method comprises contacting the cell with a nucleic acid, e.g., a vector, e.g., an AAV vector, that expresses or comprises at least one of (a), (b), (c), (d), and (e). In some embodiments, the contacting step of the method comprises contacting the cell with a nucleic acid, e.g., a vector, e.g., an AAV vector, that expresses or comprises each of (a), (b), (c), (d), and (e). In some embodiments, the contacting step of the method comprises contacting the cell with a nucleic acid, e.g., a vector, e.g., an AAV vector, that expresses or comprises two, three, or four of (a), (b), (c), (d), and (e). In some embodiments, the contacting step of the method comprises contacting the cell with a nucleic acid, e.g., a vector, e.g., an AAV vector, that expresses or comprises each of (a) and (b).

In an embodiment, contacting comprises contacting the cell with a nucleic acid, e.g., a vector, e.g., an AAV vector, e.g., an AAV2 vector, a modified AAV2 vector, an AAV3 vector, a modified AAV3 vector, an AAV6 vector, a modified AAV6 vector, an AAV8 vector or an AAV9 vector.

In an embodiment, contacting comprises delivering to the cell a Cas9 fusion molecule of (b) and a template binding domain of (d), as a protein or an mRNA, and a nucleic acid which encodes or comprises (a), (c) and (e).

In an embodiment, contacting comprises delivering to the cell a Cas9 fusion molecule of (b), as a protein or an mRNA, said gRNA of (a), as an RNA, and optionally (c) as a nucleic acid.

In some embodiments, a subject is treated by inducing a Cas9-mediated break at a target position, wherein the target position causes or exacerbates a disease or disorder, and administering one or more of (a), (b), (c), (d), and (e), wherein the break is repaired by HDR.

The method of treating a subject may comprise contacting the subject (or a cell from the subject) with (c) a template nucleic acid. A template nucleic acid is used when the method of treating a subject uses HDR to alter the sequence of the target nucleic acid of the subject.

In an embodiment, the method comprises acquiring knowledge of an undesired sequence in said subject, e.g., by DNA sequencing.

In an embodiment, the method comprises correcting an undesired sequence by HDR.

When the method comprises correcting an undesired sequence by HDR, a Cas9 fusion molecule of (b), at least one guide RNA, e.g., a guide RNA of (a) and a template nucleic acid (c) can be included in the contacting step.

In an embodiment, a cell of the subject is contacted ex vivo with (a), (b), (c), (d), and (e). In an embodiment, said cell is returned to the subject's body.

In an embodiment, a cell of the subject is contacted is in vivo with one or more of e.g., all of, (a), (b) (c), (d), and (e).

In an embodiment, the cell of the subject is contacted in vivo by intravenous delivery of one or more of, e.g., all of, (a), (b), (c), (d), and (e).

In an embodiment, contacting comprises contacting the subject with a nucleic acid, e.g., a vector, e.g., an AAV vector, described herein, e.g., a nucleic acid that encodes or comprises at least one of, e.g., all of, (a), (b), (c), (d), and (e).

In an embodiment, contacting comprises delivering to said subject said Cas9 fusion molecule of (b), as a protein or mRNA, and one or more nucleic acid which encodes or comprises at least one of, e.g., all of (a), (c), (d), and (e)

In an embodiment, contacting comprises delivering to the subject the Cas9 fusion molecule of (b), as a protein or mRNA, the gRNA of (a), as an RNA, a nucleic acid of (c) as a DNA, the template binding domain of (d) as an RNA, and a nucleic acid of (e) as a DNA.

In an embodiment, contacting comprises delivering to the subject the gRNA of (a), as an RNA, a nucleic acid that encodes the Cas9 fusion molecule of (b), and a nucleic acid of (c).

In an embodiment, a cell of the subject is contacted ex vivo with (a), (b), (c), (d), and (e). In an embodiment, said cell is returned to the subject's body.

In an embodiment, contacting comprises contacting the subject with a nucleic acid, e.g., a vector, e.g., an AAV vector, described herein, e.g., a nucleic acid that encodes or comprises at least one of, e.g., all of (a), (b), (c), (d), and (e).

In an embodiment, contacting comprises delivering to said subject the Cas9 fusion molecule of (b), as a protein or mRNA, and a nucleic acid which encodes or comprises one or more of (a), (c), (d), and (e).

In an embodiment, contacting comprises delivering to the subject the Cas9 fusion molecule of (b), as a protein or mRNA, the gRNA of (a), as an RNA, and the template nucleic acid of (c) as a DNA.

VIII.2 Examples of gRNAs in Genome Editing Methods gRNA molecules as described herein can be used with Cas9 fusion molecules that generate a double strand break or a single strand break to alter the sequence of a target nucleic acid, e.g., a target position or target genetic signature. gRNA molecules useful in these methods are described below.

In some embodiments, the gRNA is used in making double stranded breaks. In an embodiment, the gRNA, e.g., a chimeric gRNA, is configured such that it comprises one or more of the following properties:
  a) it can position, e.g., when targeting a Cas9 fusion molecule that makes double strand breaks, a double strand break (i) within 50, 100, 150 or 200 nucleotides of a target position, or (ii) sufficiently close that the target position is within the region of end resection;
b) it has a targeting domain of at least 17 nucleotides, e.g., a targeting domain of (i) 17, (ii) 18, or (iii) 20 nucleotides; and
c)
(i) the proximal and tail domain, when taken together, comprise at least 15, 18, 20, 25, 30, 31, 35, 40, 45, 49, 50, or 53 nucleotides, e.g., at least 15, 18, 20, 25, 30, 31, 35, 40, 45, 49, 50, or 53 nucleotides from a naturally occurring *S. aureus, S. thermophilus*, or *N. meningitidis* tail and proximal domain, or a sequence that differs by no more than 1, 2, 3, 4, 5, 6, 7, 8, 9 or 10 nucleotides therefrom;
(ii) there are at least 15, 18, 20, 25, 30, 31, 35, 40, 45, 49, 50, or 53 nucleotides 3' to the last nucleotide of the second complementarity domain, e.g., at least 15, 18, 20, 25, 30, 31, 35, 40, 45, 49, 50, or 53 nucleotides from the corresponding sequence of a naturally occurring *S. aureus, S. thermophilus*, or *N. meningitidis* gRNA, or a sequence that differs by no more than 1, 2, 3, 4, 5, 6, 7, 8, 9 or 10 nucleotides therefrom;
(iii) there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain, e.g., at least 16, 19, 21, 26, 31, 32, 36, 41, 46, 50, 51, or 54 nucleotides from the corresponding sequence of a naturally occurring *S. aureus, S. thermophilus*, or *N. meningitidis* gRNA, or a sequence that differs by no more than 1, 2, 3, 4, 5, 6, 7, 8, 9 or 10 nucleotides therefrom;
iv) the tail domain is at least 10, 15, 20, 25, 30, 35 or 40 nucleotides in length, e.g., it comprises at least 10, 15, 20, 25, 30, 35 or 40 nucleotides from a naturally occurring *S. aureus, S. thermophilus*, or *N. meningitidis* tail domain; or a sequence that differs by no more than 1, 2, 3, 4, 5, 6, 7, 8, 9 or 10 nucleotides therefrom; or
(v) the tail domain comprises 15, 20, 25, 30, 35, 40 nucleotides or all of the corresponding portions of a naturally occurring tail domain, e.g., a naturally occurring *S. aureus, S. thermophilus*, or *N. meningitidis* tail domain.

In an embodiment, the gRNA is configured such that it comprises properties: a and b(i).
In an embodiment, the gRNA is configured such that it comprises properties: a and b(ii).
In an embodiment, the gRNA is configured such that it comprises properties: a and b(iii).
In an embodiment, the gRNA is configured such that it comprises properties: a and c.
In an embodiment, the gRNA is configured such that in comprises properties: a, b, and c.
In an embodiment, the gRNA is configured such that in comprises properties: a(i), b(i), and c(i).
In an embodiment, the gRNA is configured such that in comprises properties: a(i), b(i), and c(ii).
In an embodiment, the gRNA is configured such that in comprises properties: a(i), b(iii), and c(i).
In an embodiment, the gRNA is configured such that in comprises properties: a(i), b(iii), and c(ii).

In some embodiments, the gRNA is used in making single stranded breaks. In an embodiment, the gRNA, e.g., a chimeric gRNA, is configured such that it comprises one or more of the following properties:
a) it can position, e.g., when targeting a Cas9 fusion molecule that makes single strand breaks, a single strand break (i) within 50, 100, 150 or 200 nucleotides of a target position, or (ii) sufficiently close that the target position is within the region of end resection;
b) it has a targeting domain of at least 17 nucleotides, e.g., a targeting domain of (i) 17, (ii) 18, or (iii) 20 nucleotides; and
c)
(i) the proximal and tail domain, when taken together, comprise at least 15, 18, 20, 25, 30, 31, 35, 40, 45, 49, 50, or 53 nucleotides, e.g., at least 15, 18, 20, 25, 30, 31, 35, 40, 45, 49, 50, or 53 nucleotides from a naturally occurring *S. aureus, S. thermophilus*, or *N. meningitidis* tail and proximal domain, or a sequence that differs by no more than 1, 2, 3, 4, 5, 6, 7, 8, 9 or 10 nucleotides therefrom;
(ii) there are at least 15, 18, 20, 25, 30, 31, 35, 40, 45, 49, 50, or 53 nucleotides 3' to the last nucleotide of the second complementarity domain, e.g., at least 15, 18, 20, 25, 30, 31, 35, 40, 45, 49, 50, or 53 nucleotides from the corresponding sequence of a naturally occurring *S. aureus, S. thermophilus*, or *N. meningitidis* gRNA, or a sequence that differs by no more than 1, 2, 3, 4, 5, 6, 7, 8, 9 or 10 nucleotides therefrom;
(iii) there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain, e.g., at least 16, 19, 21, 26, 31, 32, 36, 41, 46, 50, 51, or 54 nucleotides from the corresponding sequence of a naturally occurring *S. aureus, S. thermophilus*, or *N. meningitidis* gRNA, or a sequence that differs by no more than 1, 2, 3, 4, 5, 6, 7, 8, 9 or 10 nucleotides therefrom;
iv) the tail domain is at least 10, 15, 20, 25, 30, 35 or 40 nucleotides in length, e.g., it comprises at least 10, 15, 20, 25, 30, 35 or 40 nucleotides from a naturally occurring *S. aureus, S. thermophilus*, or *N. meningitidis* tail domain; or, a sequence that differs by no more than 1, 2, 3, 4, 5, 6, 7, 8, 9 or 10 nucleotides therefrom; or
(v) the tail domain comprises 15, 20, 25, 30, 35, 40 nucleotides or all of the corresponding portions of a naturally occurring tail domain, e.g., a naturally occurring *S. aureus, S. thermophilus*, or *N. meningitidis* tail domain.

In an embodiment, the gRNA is configured such that it comprises properties: a and b(i).
In an embodiment, the gRNA is configured such that it comprises properties: a and b(ii).
In an embodiment, the gRNA is configured such that it comprises properties: a and b(iii).
In an embodiment, the gRNA is configured such that it comprises properties: a and c.
In an embodiment, the gRNA is configured such that in comprises properties: a, b, and c.
In an embodiment, the gRNA is configured such that in comprises properties: a(i), b(i), and c(i).
In an embodiment, the gRNA is configured such that in comprises properties: a(i), b(i), and c(ii).
In an embodiment, the gRNA is configured such that in comprises properties: a(i), b(iii), and c(i).
In an embodiment, the gRNA is configured such that in comprises properties: a(i), b(iii), and c(ii).

In an embodiment, the gRNA is used with a Cas9 nickase molecule having HNH activity, e.g., a Cas9 molecule having the RuvC activity inactivated, e.g., a Cas9 molecule having a mutation at D10, e.g., the D10A mutation.

In an embodiment, the gRNA is used with a Cas9 nickase molecule having RuvC activity, e.g., a Cas9 molecule having the HNH activity inactivated, e.g., a Cas9 molecule having a mutation at H840, e.g., a H840A.

In an embodiment, a pair of gRNAs, e.g., a pair of chimeric gRNAs, comprising a first and a second gRNA, is configured such that they comprises one or more of the following properties:

a) one or both of the gRNAs can position, e.g., when targeting a Cas9 molecule that makes single strand breaks, a single strand break within (i) 50, 100, 150 or 200 nucleotides of a target position, or (ii) sufficiently close that the target position is within the region of end resection;

b) one or both have a targeting domain of at least 17 nucleotides, e.g., a targeting domain of (i) 17 or (ii) 18 nucleotides;

c) for one or both:

(i) the proximal and tail domain, when taken together, comprise at least 15, 18, 20, 25, 30, 31, 35, 40, 45, 49, 50, or 53 nucleotides, e.g., at least 15, 18, 20, 25, 30, 31, 35, 40, 45, 49, 50, or 53 nucleotides from a naturally occurring S. aureus, S. thermophilus, or N. meningitidis tail and proximal domain, or a sequence that differs by no more than 1, 2, 3, 4, 5, 6, 7, 8, 9 or 10 nucleotides therefrom;

(ii) there are at least 15, 18, 20, 25, 30, 31, 35, 40, 45, 49, 50, or 53 nucleotides 3' to the last nucleotide of the second complementarity domain, e.g., at least 15, 18, 20, 25, 30, 31, 35, 40, 45, 49, 50, or 53 nucleotides from the corresponding sequence of a naturally occurring S. aureus, S. thermophilus, or N. meningitidis gRNA, or a sequence that differs by no more than 1, 2, 3, 4, 5, 6, 7, 8, 9 or 10 nucleotides therefrom;

(iii) there are at least 16, 19, 21, 26, 31, 32, 36, 41, 46, 50, 51, or 54 nucleotides 3' to the last nucleotide of the second complementarity domain that is complementary to its corresponding nucleotide of the first complementarity domain, e.g., at least 16, 19, 21, 26, 31, 32, 36, 41, 46, 50, 51, or 54 nucleotides from the corresponding sequence of a naturally occurring S. aureus, S. thermophilus, or N. meningitidis gRNA, or a sequence that differs by no more than 1, 2, 3, 4, 5, 6, 7, 8, 9 or 10 nucleotides therefrom;

iv) the tail domain is at least 10, 15, 20, 25, 30, 35 or 40 nucleotides in length, e.g., it comprises at least 10, 15, 20, 25, 30, 35 or 40 nucleotides from a naturally occurring S. aureus, S. thermophilus, or N. meningitidis tail domain; or a sequence that differs by no more than 1, 2, 3, 4, 5, 6, 7, 8, 9 or 10 nucleotides therefrom; or (v) the tail domain comprises 15, 20, 25, 30, 35, 40 nucleotides or all of the corresponding portions of a naturally occurring tail domain, e.g., a naturally occurring S. aureus, S. thermophilus, or N. meningitidis tail domain;

d) the gRNAs are configured such that, when hybridized to target nucleic acid, they are separated by 0-50, 0-100, 0-200, at least 10, at least 20, at least 30 or at least 50 nucleotides;

e) the breaks made by the first gRNA and second gRNA are on different strands; and f) the PAMs are facing outwards.

In an embodiment, one or both of the gRNAs is configured such that it comprises properties: a and b(i).

In an embodiment, one or both of the gRNAs is configured such that it comprises properties: a and b(ii).

In an embodiment, one or both of the gRNAs is configured such that it comprises properties: a and b(iii).

In an embodiment, one or both of the gRNAs configured such that it comprises properties: a and c.

In an embodiment, one or both of the gRNAs is configured such that it comprises properties: a, b, and c.

In an embodiment, one or both of the gRNAs is configured such that it comprises properties: a(i), b(i), and c(i).

In an embodiment, one or both of the gRNAs is configured such that it comprises properties: a(i), b(i), and c(ii).

In an embodiment, one or both of the gRNAs is configured such that it comprises properties: a(i), b(i), c, and d.

In an embodiment, one or both of the gRNAs is configured such that it comprises properties: a(i), b(i), c, and e.

In an embodiment, one or both of the gRNAs is configured such that it comprises properties: a(i), b(i), c, and f.

In an embodiment, one or both of the gRNAs is configured such that it comprises properties: a(i), b(i), c, d, and e.

In an embodiment, one or both of the gRNAs is configured such that it comprises properties: a(i), b(i), c, d, and f.

In an embodiment, one or both of the gRNAs is configured such that it comprises properties: a(i), b(i), c, d, e, and f.

In an embodiment, one or both of the gRNAs is configured such that it comprises properties: a(i), b(iii), and c(i).

In an embodiment, one or both of the gRNAs is configured such that it comprises properties: a(i), b(iii), and c(ii).

In an embodiment, one or both of the gRNAs is configured such that it comprises properties: a(i), c, and d.

In an embodiment, one or both of the gRNAs is configured such that it comprises properties: a(i), c, and e.

In an embodiment, one or both of the gRNAs is configured such that it comprises properties: a(i), c, and f.

In an embodiment, one or both of the gRNAs is configured such that it comprises properties: a(i), c, d, and e.

In an embodiment, one or both of the gRNAs is configured such that it comprises properties: a(i), c, d, and f.

In an embodiment, one or both of the gRNAs is configured such that it comprises properties: a(i), c, d, e, and f.

In an embodiment, the gRNAs are used with a Cas9 nickase molecule having HNH activity, e.g., a Cas9 molecule having the RuvC activity inactivated, e.g., a Cas9 molecule having a mutation at D10, e.g., the D10A mutation.

In an embodiment, the gRNAs are used with a Cas9 nickase molecule having RuvC activity, e.g., a Cas9 molecule having the HNH activity inactivated, e.g., a Cas9 molecule having a mutation at H840, e.g., a H840A.

IX. Target Cells

Cas9 molecules and gRNA molecules, e.g., a Cas9 fusion molecule/gRNA molecule complex, as disclosed herein, can be used to manipulate, e.g., to edit a target nucleic acid, in a wide variety of cells. Additional details on types of cells that can be manipulated may be found in the section entitled "VIIA. TARGETS: CELLS" of PCT Application WO 2015/048577, the entire contents of which are expressly incorporated herein by reference.

In some embodiments, a cell is manipulated by editing (e.g., introducing a mutation or correcting) one or more target genes, e.g., as described herein. In an embodiment, a cell is manipulated by editing one or more non-coding sequences, e.g., an alteration in an intron or in a 5' or 3' non-translated or non-transcribed region. In an embodiment, a cell is manipulated by editing the sequence of a control element, e.g., a promoter, enhancer, or a cis-acting or trans-acting control element. In an embodiment, a cell is manipulated by editing one or more coding sequences, e.g., an alteration in an exon.

In some embodiments, a cell is manipulated in vitro. In other embodiments, a cell is manipulated ex vivo. In some embodiments, a cell is manipulated in vivo. In some embodiments, the expression of one or more target genes (e.g., one or more target genes described herein) is modulated, e.g., in vivo. In other embodiments, the expression of one or more target genes (e.g., one or more target genes described herein) is modulated, e.g., ex vivo. In other embodiments, the expression of one or more target genes (e.g., one or more target genes described herein) is modulated, e.g., in vitro.

In some embodiments, the cells are manipulated (e.g., converted or differentiated) from one cell type to another. In some embodiments, a pancreatic cell is manipulated into a beta islet cell. In some embodiments, a fibroblast is manipulated into an iPS cell. In some embodiments, a preadipocyte is manipulated into a brown fat cell. Other exemplary cells include, e.g., muscle cells, neural cells, leukocytes, and lymphocytes.

In some embodiments, a nucleic acid at one or more target positions in a cell, or a population of cells, is altered e.g., as described herein. In some embodiments, a nucleic acid at one or more target positions in a cell, or a population of cells (e.g., target positions at one or more genes described herein) is altered, e.g., in vivo. In other embodiments, a nucleic acid at one or more target positions in a cell, or a population of cells (e.g., target positions at one or more genes described herein) is altered, e.g., ex vivo. The Cas9 fusion molecule, nucleic acid template system, and/or gRNA molecules described herein can be delivered to a cell or to a population of cells.

In some embodiments, the cell, or the population of cells, is a T cell, a CD8+ T cell, a CD8+ naïve T cell, a central memory T cell, an effector memory T cell, a CD4+ T cell, a stem cell memory T cell, a helper T cell, a regulatory T cell, a cytotoxic T cell, a natural killer T cell, a hematopoietic stem cell, a long term hematopoietic stem cell, a short term hematopoietic stem cell, a multipotent progenitor cell, a lineage restricted progenitor cell, a lymphoid progenitor cell, a pancreatic progenitor cell, an endocrine progenitor cell, an exocrine progenitor cell, a myeloid progenitor cell, a common myeloid progenitor cell, an erythroid progenitor cell, a megakaryocyte erythroid progenitor cell, a monocytic precursor cell, an endocrine precursor cell, an exocrine cell, a fibroblast, a hepatoblast, a myoblast, a macrophage, an islet beta-cell, a cardiomyocyte, a blood cell, a ductal cell, an acinar cell, an alpha cell, a beta cell, a delta cell, a PP cell, a cholangiocyte, a retinal cell, a photoreceptor cell, a rod cell, a cone cell, a retinal pigmented epithelium cell, a trabecular meshwork cell, a cochlear hair cell, an outer hair cell, an inner hair cell, a pulmonary epithelial cell, a bronchial epithelial cell, an alveolar epithelial cell, a pulmonary epithelial progenitor cell, a striated muscle cell, a cardiac muscle cell, a muscle satellite cell, a myocyte, a neuron, a neuronal stem cell, a mesenchymal stem cell, an induced pluripotent stem (iPS) cell, an embryonic stem cell, a monocyte, a megakaryocyte, a neutrophil, an eosinophil, a basophil, a mast cell, a reticulocyte, a B cell, e.g. a progenitor B cell, a Pre B cell, a Pro B cell, a memory B cell, a plasma B cell, a gastrointestinal epithelial cell, a biliary epithelial cell, a pancreatic ductal epithelial cell, an intestinal stem cell, a hepatocyte, a liver stellate cell, a Kupffer cell, an osteoblast, an osteoclast, an adipocyte (e.g., a brown adipocyte, or a white adipocyte), a preadipocyte, a pancreatic precursor cell, a pancreatic islet cell, a pancreatic beta cell, a pancreatic alpha cell, a pancreatic delta cell, a pancreatic exocrine cell, a Schwann cell, or an oligodendrocyte, or a population of such cells.

In some embodiments, the cell, or the population of cells, is a mammalian cell, e.g., a human cell, a mouse cell, a rat cell, a sheep cell, a cow cell, a pig cell, a horse cell, a goat cell, a dog cell or a cat cell, or a population of mammalian cells. In one embodiment, the cell is a human cell.

In an embodiment, the cell, or population of cells, is manipulated ex vivo by altering a nucleic acid at one or more target positions, and administered to a subject. A cell, or population of cells, to be altered according to the methods disclosed herein, may include a stem cell such as, by way of example, an embryonic stem cell, an induced pluripotent stem cell or a neuronal stem cell, or a population of such cells. In an embodiment, the cell, or population of cells, is an induced pluripotent stem (iPS) cell or a cell derived from an iPS cell, or a population of such cells, altered to correct a mutation and differentiated into a clinically relevant cell, or population of cells.

In some embodiments, the cell is a cell from a disease-causing organism, e.g., a bacterium, fungus, protozoan, or parasite. In some embodiments, the cell is a cell infected with a disease-causing organism (e.g., a virus, fungus, protozoan, or parasite).

In some embodiments, the cell is situated in the body of a subject. In such instances, the cell might be the subject's own cells or might be a cell of a disease-causing organism. In this case, a gRNA molecule, a Cas9 fusion molecule, and a nucleic acid template system, may be administered to the subject as pharmaceutical compositions. In some embodiments, the subject is a mammal, e.g., a human, a farm animal (e.g., a cow, a pig, a horse, or a goat), or a companion animal (e.g., a dog or a cat).

In some embodiments, the subject suffers from a disease caused by a target position in a nucleic acid, e.g., a particular mutation, of a cell, or population of cells.

In some embodiments, the cell, or population of cells, is a diseased or mutant-bearing cell, or population of cells. Such cells can be altered to treat the disease, e.g., to correct a mutation, or to alter the phenotype of the cell, or population of cells, e.g., to inhibit the growth of a cancer cell or a population of cancer cells, e.g., a tumor. For example, a cell, or a population of cells, is associated with one or more diseases or conditions describe herein. In some embodiments, the cell is a cancer stem cell. In some embodiments, the cancer cell is selected from lung cancer cells, breast cancer cells, skin cancer cells, brain cancer cells, pancreatic cancer cells, hematopoietic cancer cells, liver cancer cells, kidney cancer cells, and ovarian cancer cells.

In some embodiments, the cell is characterized by a disorder caused by aberrant mtDNA. This disorder may be, e.g., a mtDNA depletion syndrome (e.g., Alpers or early infantile hepatocerebral syndromes) or a mtDNA deletion disorder (e.g., progressive external ophthalmoplegia (PEO), ataxia-neuropathy, or mitochondrial neurogastrointestinal encephalomyopathy (MNGIE)).

In some embodiments, the cell, or population of cells, is a normal cell or a population of normal cells.

In some embodiments, the cell, or population of cells, is a stem cell or a progenitor cell (e.g., iPS, embryonic, hematopoietic, adipose, germline, lung, or neural stem or progenitor cells), or a population of such cells.

The cells may also be treated at a time when they are not situated in the body of a subject. In some embodiments, a cell, or a population of cells, is treated ex vivo to avoid exposing a patient to an agent or agents that cause undesirable side effects. In some embodiments, treating cells ex vivo allows a user to select a sub-population of cells to administer to the patient. The sub-population may be, e.g., cells having a nucleic acid that was successfully altered, or cells having a desired phenotype, such as minimal undesired alterations to DNA, or a phenotype that indicates the nucleic acid was successfully altered.

In some embodiments, the cell, or population of cells, is not situated in a subject's body and the cell, or population of cells, is modified for research or manufacturing purposes. In some embodiments, the cell, or population of cells, is suitable for producing a recombinant biological product. For example, the cell, or population of cells, can be a CHO cell or a fibroblast. In one embodiment, the cell, or population of cells, is a cell, or population of cells, that has been engineered to express a protein.

In some embodiments, the cell, or population of cells, is actively dividing. In some embodiments, the cell is in G2 phase. In some embodiments, the population of cells comprises cells that are in G2 phase. In some embodiments, the cell is in G1 phase. In some embodiments, the population of cells comprises cells that are in G1 phase. In some embodiments, the cell is in S phase. In some embodiments, the population of cells comprises cells that are in S phase.

The technology described herein can be used to edit numerous types of genomes, including plant genomes. The CRISPR/Cas system has been used for plant genome editing, as has been described in, e.g., Belhaj et al., PLANT METHODS 9:39, 2013. Accordingly, in certain embodiments, the cell, or the population of cells, is a plant cell, e.g., a monocot plant cell, or a dicot plant cell, or a population of plant cell. In certain embodiments, the plant is a crop, e.g., a food crop. In certain embodiments, the plant is rice (e.g., *Orzya sativa*), maize (e.g., *Zea mays*), wheat (e.g., *Triticum aestivum*), soy (e.g., *Glycine max*), potato (e.g., *Solanum tuberosum*), a species of *Nicotiana*, a species of *Arabidopsis* e.g., *Arabidopsis thaliana*, cassava, sweet potato, sorghum, yam, plantain, or a citrus plant. In some embodiments, the plant is a pesticide-resistant plant, e.g., a plant that expresses one or more genes that confer resistance to a pesticide. In some embodiments, the plant is herbicide-resistant plant, e.g., a plant that expresses one or more genes that confer resistance to a herbicide. The herbicide may be, e.g., Roundup® (also known as glyphosate or N-(phosphonomethyl)glycine). In some embodiments, the plant produces a pesticide, e.g., Bt.

In some embodiments, the components used in the methods described herein (e.g., a Cas9 fusion molecule, a nucleic acid template system, and/or a gRNA) are introduced into the plant cell via protoplast transformation or agroinfiltration.

In some embodiments, after genome editing using the methods described herein, seeds are screened and a desired sub-population of seeds are selected. The sub-population may be, e.g., cells having a nucleic acid that was successfully altered, or cells having a desired phenotype such as minimal undesired alterations to DNA, or a phenotype that indicates the nucleic acid was successfully altered.

X. Delivery, Formulations and Routes of Administration

The components, e.g., a Cas9 fusion molecule, a nucleic acid template system, and/or a gRNA molecule can be delivered or formulated in a variety of forms, see, e.g., Tables 4-5. When a Cas9 fusion molecule, nucleic acid template system component, and/or a gRNA component is encoded by DNA for delivery, the DNA will typically but not necessarily include a control region, e.g., comprising a promoter, to effect expression. Useful promoters for Cas9 fusion molecule sequences include CMV, EF-1a, MSCV, PGK, CAG control promoters. Useful promoters for gRNAs include H1, EF-1a and U6 promoters. Promoters with similar or dissimilar strengths can be selected to tune the expression of components. Sequences encoding a Cas9 fusion molecule can comprise a nuclear localization signal (NLS), e.g., an SV40 NLS. In an embodiment a promoter for a Cas9 fusion molecule or a gRNA molecule can be, independently, inducible, tissue specific, or cell specific.

Table 4 provides non-limiting examples of the form in which the components can be delivered to a target cell.

TABLE 4

| | | | |
|---|---|---|---|
| | | | Elements |
| Cas9 Fusion Molecule(s) | gRNA Molecule(s) | Template Nucleic Acid System | Comments |
| DNA | DNA | DNA | In some embodiments, a Cas9 fusion molecule, e.g., an eaCas9 fusion molecule, and a gRNA are transcribed from DNA. In this embodiment, they are encoded on separate molecules. In this embodiment, the donor template is provided as a separate DNA molecule. In some embodiments, the template binding domain is encoded by DNA, optionally on the same nucleic acid as the Cas9 fusion molecule. In some embodiments, the template binding domain partner is provided as DNA, and is optionally part of the same nucleic acid as the donor template. |
| DNA | DNA | | In an embodiment, a Cas9 fusion molecule, e.g., an eaCas9 fusion molecule, and a gRNA are transcribed from DNA. In this embodiment, they are encoded on separate molecules. In this embodiment, the donor template is provided on the same DNA molecule that encodes the gRNA. In some embodiments, the template binding domain |

TABLE 4-continued

| Elements | | | |
|---|---|---|---|
| Cas9 Fusion Molecule(s) | gRNA Molecule(s) | Template Nucleic Acid System | Comments |
| DNA | | DNA | is encoded in DNA, optionally on the same nucleic acid as the Cas9 fusion molecule. In some embodiments, the template binding domain partner is provided as DNA, and is optionally part of the same nucleic acid as the donor template.<br>In some embodiments, a Cas9 fusion molecule, e.g., an eaCas9 fusion molecule, and a gRNA are transcribed from DNA, here from a single molecule. In this embodiment, the donor template is provided as a separate DNA molecule. In some embodiments, the template binding domain is encoded in DNA, optionally on the same nucleic acid as the Cas9 fusion molecule. In some embodiments, the template binding domain partner is provided as DNA, and is optionally part of the same nucleic acid as the donor template. |
| DNA | DNA | DNA | In some embodiments, a Cas9 fusion molecule, e.g., an eaCas9 fusion molecule, and a gRNA are transcribed from DNA. In this embodiment, they are encoded on separate molecules. In this embodiment, the donor template is provided on the same DNA molecule that encodes the Cas9 fusion molecule. In some embodiments, the template binding domain is encoded in DNA, optionally on the same nucleic acid as the Cas9 fusion molecule. In some embodiments, the template binding domain partner is provided as DNA, and is optionally part of the same nucleic acid as the donor template. |
| DNA | RNA | DNA | In some embodiments, a Cas9 fusion molecule, e.g., an eaCas9 fusion molecule, is transcribed from DNA, and a gRNA is provided as in vitro transcribed or synthesized RNA. In this embodiment, the donor template is provided as a separate DNA molecule. In some embodiments, the template binding domain is encoded in DNA, optionally on the same nucleic acid as the Cas9 fusion molecule. In some embodiments, the template binding domain partner is provided as DNA, and is optionally part of the same nucleic acid as the donor template. |
| DNA | RNA | DNA | In some embodiments, a Cas9 fusion molecule, e.g., an eaCas9 fusion molecule, is transcribed from DNA, and a gRNA is provided as in vitro transcribed or synthesized RNA. In this embodiment, the donor template is provided on the same DNA molecule that encodes the Cas9 fusion molecule. In some embodiments, the template binding domain is encoded in DNA, optionally on the same nucleic acid as the Cas9 fusion molecule. In some embodiments, the template binding domain partner is provided as DNA, and is optionally part of the same nucleic acid as the donor template. |
| mRNA | RNA | DNA | In some embodiments, a Cas9 fusion molecule, e.g., an eaCas9 fusion molecule, is translated from in vitro transcribed mRNA, and a gRNA is provided as in vitro transcribed or synthesized RNA. In this embodiment, the donor template is provided as a DNA molecule. In some embodiments, the template binding domain is translated form in vitro transcribed mRNA, and is optionally part of the same nucleic acid as |

TABLE 4-continued

| Cas9 Fusion Molecule(s) | gRNA Molecule(s) | Template Nucleic Acid System | Comments |
|---|---|---|---|
| | | | the Cas9 fusion molecule. In some embodiments, the template binding domain partner is provided as DNA, and is optionally part of the same nucleic acid as the donor template. |
| mRNA | DNA | DNA | In some embodiments, a Cas9 fusion molecule, e.g., an eaCas9 fusion molecule, is translated from in vitro transcribed mRNA, and a gRNA is transcribed from DNA. In this embodiment, the donor template is provided as a separate DNA molecule. In some embodiments, the template binding domain is translated form in vitro transcribed mRNA, and is optionally part of the same nucleic acid as the Cas9 fusion molecule. In some embodiments, the template binding domain partner is provided as DNA, and is optionally part of the same nucleic acid as the donor template. |
| mRNA | DNA | | In some embodiments, a Cas9 fusion molecule, e.g., an eaCas9 fusion molecule, is translated from in vitro transcribed mRNA, and a gRNA is transcribed from DNA. In this embodiment, the donor template is provided on the same DNA molecule that encodes the gRNA. In some embodiments, the template binding domain is translated form in vitro transcribed mRNA, and is optionally part of the same nucleic acid as the Cas9 fusion molecule. In some embodiments, the template binding domain partner is provided as DNA, and is optionally part of the same nucleic acid as the donor template. |
| Protein | DNA | DNA | In some embodiments, a Cas9 fusion molecule, e.g., an eaCas9 fusion molecule, is provided as a protein, and a gRNA is transcribed from DNA. In this embodiment, the donor template is provided as a separate DNA molecule. In some embodiments, the template binding domain is provided as a protein, and is optionally covalently linked to, e.g., fused to, the Cas9 fusion molecule. In some embodiments, the template binding domain partner is provided as DNA, and is optionally part of the same nucleic acid as the donor template. |
| Protein | DNA | DNA | In some embodiments, a Cas9 fusion molecule, e.g., an eaCas9 fusion molecule, is provided as a protein, and a gRNA is transcribed from DNA. In this embodiment, the donor template is provided on the same DNA molecule that encodes the gRNA. In some embodiments, the template binding domain is provided as a protein, and is optionally covalently linked to, e.g., fused to, the Cas9 molecule. In some embodiments, the template binding domain partner is provided as DNA, and is optionally part of the same nucleic acid as the donor template. |
| Protein | RNA | DNA | In some embodiments, a Cas9 fusion molecule, e.g., an eaCas9 fusion molecule is provided as a protein, and a gRNA is provided as transcribed or synthesized RNA. In this embodiment, the donor template is provided as a DNA molecule. In some embodiments, the template binding domain is provided as a protein, and is optionally covalently linked to, e.g., fused to, the Cas9 fusion molecule. In some embodiments, the template binding domain |

TABLE 4-continued

| Elements | | | |
|---|---|---|---|
| Cas9 Fusion Molecule(s) | gRNA Molecule(s) | Template Nucleic Acid System | Comments |
| | | | partner is provided as DNA, and is optionally part of the same nucleic acid as the donor template. |

Table 5 summarizes various delivery methods for the components of a Cas9 system, e.g., the Cas9 fusion molecule, the nucleic acid template system, and a gRNA molecule, as described herein.

TABLE 5

| Delivery Vector/Mode | | Delivery into Non-Dividing Cells | Duration of Expression | Genome Integration | Type of Molecule Delivered |
|---|---|---|---|---|---|
| Physical (e.g., electroporation, particle gun, Calcium Phosphate transfection) | | YES | Transient | NO | Nucleic Acids and Proteins |
| Viral | Retrovirus | NO | Stable | YES | |
| | Lentivirus | YES | Stable | YES/NO with modifications | RNA |
| | Adenovirus | YES | Transient | NO | DNA |
| | Adeno-Associated Virus (AAV) | YES | Stable | NO | DNA |
| | Vaccinia Virus | YES | Very Transient | NO | DNA |
| | Herpes Simplex Virus | YES | Stable | NO | DNA |
| Non-Viral | Cationic Liposomes | YES | Transient | Depends on what is delivered | Nucleic Acids and Proteins |
| | Polymeric Nanoparticles | YES | Transient | Depends on what is delivered | Nucleic Acids and Proteins |
| Biological Non-Viral Delivery Vehicles | Attenuated Bacteria | YES | Transient | NO | Nucleic Acids |
| | Engineered Bacteriophages | YES | Transient | NO | Nucleic Acids |
| | Mammalian Virus-like Particles | YES | Transient | NO | Nucleic Acids |
| | Biological liposomes: Erythrocyte Ghosts and Exosomes | YES | Transient | NO | Nucleic Acids |

DNA-Based Delivery of a Cas9 Fusion Molecule, Nucleic Acid Template System and/or a gRNA Molecule DNA encoding Cas9 fusion molecules (e.g., eaCas9 fusion molecules), gRNA molecules, template nucleic acids, template binding domains, and/or template binding domain partners can be administered to subjects or delivered into cells by any appropriate method, e.g., by art-known methods or as described herein. For example, Cas9 fusion molecule-encoding and/or gRNA-encoding DNA, a template binding domain partner, and a template nucleic acid can be delivered, e.g., by vectors (e.g., viral or non-viral vectors), non-vector based methods (e.g., using naked DNA or DNA complexes), or a combination thereof.

In some embodiments, the nucleic acid, e.g., Cas9 fusion molecule- and/or gRNA-encoding DNA is delivered by a vector (e.g., viral vector/virus or plasmid).

In one embodiment, a vector can comprise a sequence that encodes a Cas9 fusion molecule, a gRNA molecule, and a nucleic acid template system. In one embodiment, a vector can comprise a sequence encoding a signal peptide (e.g., for nuclear localization, nucleolar localization, mitochondrial localization), fused, e.g., to a Cas9 fusion molecule sequence. For example, a vector can comprise a nuclear localization sequence (e.g., from SV40) fused to the sequence encoding the Cas9 fusion molecule.

One or more regulatory/control elements, e.g., a promoter, an enhancer, an intron, a polyadenylation signal, a Kozak consensus sequence, internal ribosome entry sites (IRES), a 2A sequence, and splice acceptor or donor, can be included in the vectors. In some embodiments, the promoter is recognized by RNA polymerase II (e.g., a CMV promoter).

In some embodiments, the vector or delivery vehicle is a viral vector (e.g., for generation of recombinant viruses). In some embodiments, the virus is a DNA virus (e.g., dsDNA or ssDNA virus). In other embodiments, the virus is an RNA virus (e.g., an ssRNA virus). Exemplary viral vectors/viruses include, e.g., retroviruses, lentiviruses, adenovirus, adeno-associated virus (AAV), vaccinia viruses, poxviruses, and herpes simplex viruses.

In some embodiments, the virus infects dividing cells. In other embodiments, the virus infects non-dividing cells. In some embodiments, the virus infects both dividing and non-dividing cells. In some embodiments, the virus can integrate into the host genome. In some embodiments, the virus is engineered to have reduced immunity, e.g., in human. In some embodiments, the virus is replication-competent. In other embodiments, the virus is replication-defective, e.g., having one or more coding regions for the genes necessary for additional rounds of virion replication and/or packaging replaced with other genes or deleted. In some embodiments, the virus causes transient expression of the Cas9 fusion molecule and/or the gRNA molecule. In other embodiments, the virus causes long-lasting, e.g., at least 1 week, 2 weeks, 1 month, 2 months, 3 months, 6 months, 9 months, 1 year, 2 years, or permanent expression, of the Cas9 fusion molecule and/or the gRNA molecule. The packaging capacity of the viruses may vary, e.g., from at least about 4 kb to at least about 30 kb, e.g., at least about 5 kb, 10 kb, 15 kb, 20 kb, 25 kb, 30 kb, 35 kb, 40 kb, 45 kb, or 50 kb.

In some embodiments, the Cas9 fusion molecule-, gRNA-, and/or template binding domain-encoding DNA and/or the nucleic acid template system is delivered by a recombinant adenovirus. In some embodiments, the adenovirus is engineered to have reduced immunity in human.

In some embodiments, the Cas9 fusion molecule-, gRNA-, and/or template binding domain-encoding DNA and/or the nucleic acid template system is delivered by a recombinant AAV. In some embodiments, the AAV can incorporate its genome into that of a host cell, e.g., a target cell as described herein. In some embodiments, the AAV is a self-complementary adeno-associated virus (scAAV), e.g., a scAAV that packages both strands which anneal together to form double stranded DNA. AAV serotypes that may be used in the disclosed methods, include AAV1, AAV2, modified AAV2 (e.g., modifications at Y444F, Y500F, Y730F and/or S662V), AAV3, modified AAV3 (e.g., modifications at Y705F, Y731F and/or T492V), AAV4, AAV5, AAV6, modified AAV6 (e.g., modifications at S663V and/or T492V), AAV8, AAV 8.2, AAV9, AAV rh10, and pseudo-typed AAV, such as AAV2/8, AAV2/5 and AAV2/6 can also be used in the disclosed methods.

In some embodiments, the Cas9 fusion molecule-gRNA-, and/or template binding domain-encoding DNA, and/or the nucleic acid template system is delivered by a non-vector based method (e.g., using naked DNA or DNA complexes). For example, the DNA can be delivered, e.g., by organically modified silica or silicate (Ormosil), electroporation, gene gun, sonoporation, magnetofection, lipid-mediated transfection, dendrimers, inorganic nanoparticles, calcium phosphates, or a combination thereof.

In an embodiment, the delivery vehicle is a non-viral vector. In an embodiment, the non-viral vector is an inorganic nanoparticle. Exemplary inorganic nanoparticles include, e.g., magnetic nanoparticles (e.g., $Fe_3MnO_2$) and silica. The outer surface of the nanoparticle can be conjugated with a positively charged polymer (e.g., polyethylenimine, polylysine, polyserine) which allows for attachment (e.g., conjugation or entrapment) of payload. In an embodiment, the non-viral vector is an organic nanoparticle (e.g., entrapment of the payload inside the nanoparticle). Exemplary organic nanoparticles include, e.g., SNALP liposomes that contain cationic lipids together with neutral helper lipids which are coated with polyethylene glycol (PEG) and protamine and nucleic acid complex coated with lipid coating.

Exemplary lipids for gene transfer are shown below in Table 6.

TABLE 6

Lipids Used for Gene Transfer

| Lipid | Abbreviation | Feature |
|---|---|---|
| 1,2-Dioleoyl-sn-glycero-3-phosphatidylcholine | DOPC | Helper |
| 1,2-Dioleoyl-sn-glycero-3-phosphatidylethanolamine | DOPE | Helper |
| Cholesterol | | Helper |
| N-[1-(2,3-Dioleyloxy)prophyl]N,N,N-trimethylammonium chloride | DOTMA | Cationic |
| 1,2-Dioleoyloxy-3-trimethy lammonium-propane | DOTAP | Cationic |
| Dioctadecylamidoglycylspermine | DOGS | Cationic |
| N-(3-Aminopropyl)-N,N-dimethyl-2,3-bis(dodecyloxy)-1-propanaminium bromide | GAP-DLRIE | Cationic |
| Cetyltrimethylammonium bromide | CTAB | Cationic |
| 6-Lauroxyhexyl ornithinate | LHON | Cationic |
| 1-(2,3-Dioleoyloxypropyl)-2,4,6-trimethylpyridinium | 2Oc | Cationic |
| 2,3-Dioleyloxy-N-[2(sperminecarboxamido-ethyl]-N,N-dimethyl-1-propanaminium trifluoroacetate | DOSPA | Cationic |
| 1,2-Dioleyl-3-trimethylammonium-propane | DOPA | Cationic |
| N-(2-Hydroxyethyl)-N,N-dimethyl-2,3-bis(tetradecyloxy)-1-propanaminium bromide | MDRIE | Cationic |
| Dimyristooxypropyl dimethyl hydroxyethyl ammonium bromide | DMRI | Cationic |
| 3B-[N-(N',N'-Dimethylaminoethane)-carbamoyl]cholesterol | DC-Chol | Cationic |
| Bis-guanidium-tren-cholesterol | BGTC | Cationic |
| 1,3-Diodeoxy-2-(6-carboxy-spermyl)-propylamide | DOSPER | Cationic |
| Dimethyloctadecylammonium bromide | DDAB | Cationic |
| Dioctadecylamidoglicylspermidin | DSL | Cationic |
| rac-[(2,3-Dioctadecyloxypropyl)(2-hydroxyethyl)]-dimethylammonium chloride | CLIP-1 | Cationic |
| rac-[2(2,3-Dihexadecyloxypropyl-oxymethyloxy)ethyl]trimethylammonium bromide | CLIP-6 | Cationic |
| Ethyldimyristoy lphosphatidylcholine | EDMPC | Cationic |
| 1,2-Distearyloxy-N,N-dimethyl-3-aminopropane | DSDMA | Cationic |
| 1,2-Dimyristoyl-trimethylammonium propane | DMTAP | Cationic |

TABLE 6-continued

Lipids Used for Gene Transfer

| Lipid | Abbreviation | Feature |
|---|---|---|
| O,O'-Dimyristyl-N-lysyl aspartate | DMKE | Cationic |
| 1,2-Distearoyl-sn-glycero-3-ethylphosphocholine | DSEPC | Cationic |
| N-Palmitoyl D-erythro-sphingosyl carbamoyl-spermine | CCS | Cationic |
| N-t-Butyl-N0-tetradecyl-3-tetradecylaminopropionamidine | diC14-amidine | Cationic |
| Octadecenolyoxy[ethyl-2-heptadecenyl-3 hydroxyethyl] imidazolinium chloride | DOTIM | Cationic |
| N1-Cholesteryloxycarbonyl-3,7-diazanonane-1,9-diamine | CDAN | Cationic |
| 2-(3-[Bis(3-amino-propyl)-amino]propylamino)-N-ditetradecylcarbamoylme-ethyl-acetamide | RPR209120 | Cationic |
| 1,2-dilinoleyloxy-3-dimethylaminopropane | DLinDMA | Cationic |
| 2,2-dilinoleyl-4-dimethylaminoethyl-[1,3]-dioxolane | DLin-KC2-DMA | Cationic |
| dilinoleyl-methyl-4-dimethylaminobutyrate | DLin-MC3-DMA | Cationic |

Exemplary polymers for gene transfer are shown below in Table 7.

TABLE 7

Polymers Used for Gene Transfer

| Polymer | Abbreviation |
|---|---|
| Poly(ethylene)glycol | PEG |
| Polyethylenimine | PEI |
| Dithiobis(succinimidylpropionate) | DSP |
| Dimethyl-3,3'-dithiobispropionimidate | DTBP |
| Poly(ethylene imine )biscarbamate | PEIC |
| Poly(L-lysine) | PLL |
| Histidine modified PLL | |
| Poly(N-vinylpyrrolidone) | PVP |
| Poly(propylenimine) | PPI |
| Poly(amidoamine) | PAMAM |
| Poly(amidoethylenimine) | SS-PAEI |
| Triethylenetetramine | TETA |
| Poly(β-aminoester) | |
| Poly(4-hydroxy-L-proline ester) | PHP |
| Poly(allylamine) | |
| Poly(a-[4-aminobutyl]-L-glycolic acid) | PAGA |
| Poly(D,L-lactic-co-glycolic acid) | PLGA |
| Poly(N-ethyl-4-vinylpyridinium bromide) | |
| Poly(phosphazene)s | PPZ |
| Poly(phosphoester)s | PPE |
| Poly(phosphoramidate)s | PPA |
| Poly(N-2-hydroxypropylmethacrylamide) | pHPMA |
| Poly (2-(dimethylamino)ethyl methacrylate) | pDMAEMA |
| Poly(2-aminoethyl propylene phosphate) | PPE-EA |
| Chitosan | |
| Galactosylated chitosan | |
| N-Dodacylated chitosan | |
| Histone | |
| Collagen | |
| Dextran-spermine | D-SPM |

In an embodiment, the vehicle has targeting modifications to increase target cell update of nanoparticles and liposomes, e.g., cell specific antigens, monoclonal antibodies, single chain antibodies, aptamers, polymers, sugars, and cell penetrating peptides. In an embodiment, the vehicle uses fusogenic and endosome-destabilizing peptides/polymers. In an embodiment, the vehicle undergoes acid-triggered conformational changes (e.g., to accelerate endosomal escape of the cargo). In an embodiment, a stimuli-cleavable polymer is used, e.g., for release in a cellular compartment. For example, disulfide-based cationic polymers that are cleaved in the reducing cellular environment can be used.

In an embodiment, the delivery vehicle is a biological non-viral delivery vehicle.

In an embodiment, one or more nucleic acid molecules (e.g., a DNA molecule or a nucleic acid template system) other than the components of a Cas9 system, e.g., the Cas9 fusion molecule component and/or the gRNA molecule component described herein, are delivered. In an embodiment, the nucleic acid molecule is delivered at the same time as one or more of the components of the Cas9 system are delivered. In an embodiment, the nucleic acid molecule is delivered before or after (e.g., less than about 30 minutes, 1 hour, 2 hours, 3 hours, 6 hours, 9 hours, 12 hours, 1 day, 2 days, 3 days, 1 week, 2 weeks, or 4 weeks) one or more of the components of the Cas9 system are delivered. In an embodiment, the nucleic acid molecule is delivered by a different means than one or more of the components of the Cas9 system, e.g., the Cas9 fusion molecule component and/or the gRNA molecule component, are delivered. The nucleic acid molecule can be delivered by any of the delivery methods described herein. For example, the nucleic acid molecule can be delivered by a viral vector, e.g., an integration-deficient lentivirus, and the Cas9 fusion molecule component and/or the gRNA molecule component can be delivered by electroporation, e.g., such that the toxicity caused by nucleic acids (e.g., DNA) is reduced. In an embodiment, the nucleic acid molecule encodes a therapeutic protein, e.g., a protein described herein. In an embodiment, the nucleic acid molecule encodes an RNA molecule, e.g., an RNA molecule described herein. In some embodiments, the nucleic acid is a nucleic acid template system capable of participating in HDR.

Delivery of RNA Encoding a Cas9 Fusion Molecule

RNA encoding Cas9 fusion molecules (e.g., mRNA encoding an eaCas9 fusion molecules), gRNA molecules, and/or template binding domains can be delivered into cells, or populations of cells, described herein, by any appropriate method, including art-known methods or methods described herein. For example, Cas9 fusion molecule-, gRNA-, and/or template binding domain-encoding RNA, e.g., mRNA can be delivered, e.g., by microinjection, electroporation, lipid-mediated transfection, peptide-mediated delivery, or a combination thereof Delivery of Cas9 Fusion Molecule Protein Cas9 fusion molecules (e.g., eaCas9 fusion molecules) and/or template binding domains can be delivered into cells by any appropriate method, including art-known methods or methods described herein. For example, the protein molecules can be delivered, e.g., by microinjection, electroporation, lipid-mediated transfection, peptide-mediated delivery, or a combination thereof. Delivery can be accompanied by DNA encoding a gRNA, or by a gRNA, a nucleic acid template system, and/or DNA encoding a template binding domain partner.

Routes of Administration

Systemic modes of administration include oral and parenteral routes. Parenteral routes include, by way of example, intravenous, intrarterial, intraosseous, intramuscular, intradermal, subcutaneous, intranasal and intraperitoneal routes. Components administered systemically may be modified or formulated to target the components to the desired cell type.

Local modes of administration include, by way of example, intrathecal, intracerebroventricular, intraparenchymal (e.g., localized intraparenchymal delivery to the striatum (e.g., into the caudate or into the putamen)), cerebral cortex, precentral gyrus, hippocampus (e.g., into the dentate gyrus or CM region), temporal cortex, amygdala, frontal cortex, thalamus, cerebellum, medulla, hypothalamus, tectum, tegmentum or substantia nigra intraocular, intraorbital, subconjuctival, intravitreal, subretinal or transscleral routes. In an embodiment, significantly smaller amounts of the components (compared with systemic approaches) may exert an effect when administered locally (for example, intraparenchymal or intravitreal) compared to when administered systemically (for example, intravenously). Local modes of administration can reduce or eliminate the incidence of potentially toxic side effects that may occur when therapeutically effective amounts of a component are administered systemically.

Administration may be provided as a periodic bolus or as continuous infusion from an internal reservoir or from an external reservoir (for example, from an intravenous bag). Components may be administered locally, for example, by continuous release from a sustained release drug delivery device.

Bi-Modal or Differential Delivery of Components

Separate delivery of the components of a Cas9 system, e.g., the Cas9 fusion molecule component, the gRNA molecule component, the template binding domain, the template binding domain partner, and/or the nucleic acid template system, and more particularly, delivery of the components by differing modes, can enhance performance, e.g., by improving tissue specificity and safety.

In an embodiment, one or more of the Cas9 fusion molecule, the gRNA molecule, the template binding domain, the template binding domain partner, and/or the nucleic acid template system, are delivered by different modes, or as sometimes referred to herein as differential modes. Different or differential modes, as used herein, refer to modes of delivery that confer different pharmacodynamic or pharmacokinetic properties on the subject component molecule, e.g., a Cas9 fusion molecule, gRNA molecule, nucleic acid template system, template binding domain, and/or template binding domain partner. For example, the modes of delivery can result in different tissue distribution, different half-life, or different temporal distribution, e.g., in a selected compartment, tissue, or organ. In many embodiments, the components are delivered so that one or more of; e.g., all of a Cas9 fusion molecule, gRNA molecule, nucleic acid template system, template binding domain, and template binding domain partner will be present in the same cell at the same time.

In some embodiments, two gRNAs are delivered to a cell so that a first nickase will make a first single stranded break and a second nickase will make a second single stranded break. In such embodiments, the two gRNAs and other components (e.g., the Cas9 fusion molecule) are delivered such that the two breaks are made at substantially the same time. In some embodiments this comprises the second break being formed before the first break engages with machinery specific to the SSBR (single stranded break repair) pathway, and in some embodiments, it comprises the second break being formed before the first break is repaired. More generally, when one desires to make two or more breaks in a target nucleic acid, the gRNAs and other components can be delivered such that the two or more breaks are made at substantially the same time.

Some modes of delivery, e.g., delivery by a nucleic acid vector that persists in a cell, or in progeny of a cell, e.g., by autonomous replication or insertion into cellular nucleic acid, result in more persistent expression of and presence of a component. Examples include viral, e.g., adeno-associated virus or lentivirus, delivery.

By way of example, the components, e.g., a Cas9 fusion molecule, a gRNA molecule, nucleic acid template system, template binding domain, and template binding domain partner can be delivered by modes that differ in terms of resulting half-life or persistent of the delivered component the body, or in a particular compartment, tissue or organ. In an embodiment, one or more of, e.g., all of, a gRNA molecule, nucleic acid template system, template binding domain, and template binding domain partner can be delivered by such modes. The Cas9 fusion molecule component can be delivered by a mode which results in less persistence or less exposure to the body or a particular compartment or tissue or organ.

More generally, in an embodiment, a first mode of delivery is used to deliver a first component and a second mode of delivery is used to deliver a second component. The first mode of delivery confers a first pharmacodynamic or pharmacokinetic property. The first pharmacodynamic property can be, e.g., distribution, persistence, or exposure, of the component, or of a nucleic acid that encodes the component, in the body, a compartment, tissue or organ. The second mode of delivery confers a second pharmacodynamic or pharmacokinetic property. The second pharmacodynamic property can be, e.g., distribution, persistence, or exposure, of the component, or of a nucleic acid that encodes the component, in the body, a compartment, tissue or organ.

In an embodiment, the first pharmacodynamic or pharmacokinetic property, e.g., distribution, persistence or exposure, is more limited than the second pharmacodynamic or pharmacokinetic property.

In an embodiment, the first mode of delivery is selected to optimize, e.g., minimize, a pharmacodynamic or pharmacokinetic property, e.g., distribution, persistence or exposure.

In an embodiment, the second mode of delivery is selected to optimize, e.g., maximize, a pharmacodynamic or pharmacokinetic property, e.g., distribution, persistence or exposure.

In an embodiment, the first mode of delivery comprises the use of a relatively persistent element, e.g., a nucleic acid, e.g., a plasmid or viral vector, e.g., an AAV or lentivirus. As such vectors are relatively persistent product transcribed from them would be relatively persistent.

In an embodiment, the second mode of delivery comprises a relatively transient element, e.g., an RNA or protein.

In an embodiment, the first component comprises a gRNA, template nucleic acid, template binding domain, or template binding domain partner and the delivery mode is relatively persistent, e.g., the gRNA is transcribed from a plasmid or viral vector, e.g., an AAV or lentivirus. Transcription of these genes would be of little physiological consequence because the genes generally do not encode for a protein product, and the gRNAs are incapable of acting in isolation. The second component, a Cas9 fusion molecule, is delivered in a transient manner, for example as mRNA or as protein, ensuring that the full Cas9 fusion molecule/gRNA molecule complex is only present and active for a short period of time.

Furthermore, the components can be delivered in different molecular form or with different delivery vectors that complement one another to enhance safety and tissue specificity.

Use of differential delivery modes can enhance performance, safety and efficacy. For example, the likelihood of an eventual off-target modification can be reduced. Delivery of immunogenic components, e.g., Cas9 fusion molecules, by less persistent modes can reduce immunogenicity, as peptides from the bacterially-derived Cas enzyme are displayed on the surface of the cell by MEW molecules. A two-part delivery system can alleviate these drawbacks.

Differential delivery modes can be used to deliver components to different, but overlapping target regions. The formation active complex is minimized outside the overlap of the target regions. Thus, in an embodiment, a first component, e.g., a gRNA molecule is delivered by a first delivery mode that results in a first spatial, e.g., tissue, distribution. A second component, e.g., a Cas9 fusion molecule is delivered by a second delivery mode that results in a second spatial, e.g., tissue, distribution. In an embodiment, the first mode comprises a first element selected from a liposome, nanoparticle, e.g., polymeric nanoparticle, and a nucleic acid, e.g., viral vector. The second mode comprises a second element selected from the group. In an embodiment, the first mode of delivery comprises a first targeting element, e.g., a cell specific receptor or an antibody, and the second mode of delivery does not include that element. In embodiment, the second mode of delivery comprises a second targeting element, e.g., a second cell specific receptor or second antibody.

When the Cas9 fusion molecule is delivered in a virus delivery vector, a liposome, or polymeric nanoparticle, there is the potential for delivery to and therapeutic activity in multiple tissues, when it may be desirable to only target a single tissue. A two-part delivery system can resolve this challenge and enhance tissue specificity. If the gRNA molecule and the Cas9 fusion molecule are packaged in separated delivery vehicles with distinct but overlapping tissue tropism, the fully functional complex is only formed in the tissue that is targeted by both vectors.

Ex Vivo Delivery

In some embodiments, components described in Table 4 are introduced into cells which are then introduced into the subject. Methods of introducing the components can include, e.g., any of the delivery methods described in Table 5.

In some embodiments, the cells are contacted with a Cas9 fusion molecule (or a nucleic acid encoding it) ex vivo. In some embodiments, the cells are contacted with a gRNA (or a nucleic acid encoding it) ex vivo. In some embodiment, the cells are contacted with a template nucleic acid ex vivo. In some embodiment, the cells are contacted with a template binding domain (or a nucleic acid encoding it) ex vivo. In some embodiment, the cells are contacted with a template binding domain partner ex vivo. In some embodiments, the cells are contacted with the nucleic acid template system ex vivo. In some embodiments, the cells are contacted with two, three, four, or all of the preceding compositions (or nucleic acids encoding them) ex vivo. In some embodiments, the cells are contacted with one or more of the preceding components (or nucleic acids encoding them), and one or more remaining components are administered to the patient.

XI. Modified Nucleosides, Nucleotides, and Nucleic Acids

Modified nucleosides and modified nucleotides can be present in nucleic acids, e.g., particularly gRNA, a template binding domain partner, and/or a template nucleic acid, but also other forms of DNA or RNA, e.g., mRNA. As described herein, "nucleoside" is defined as a compound containing a five-carbon sugar molecule (a pentose such as deoxyribose or ribose) or derivative thereof; and an organic base (purine or pyrimidine, or a derivative thereof). As described herein, "nucleotide" is defined as a nucleoside further comprising a phosphate group.

Modified nucleosides and nucleotides can include one or more of:

(i) alteration, e.g., replacement, of one or both of the non-linking phosphate oxygens and/or of one or more of the linking phosphate oxygens in the phosphodiester backbone linkage;

(ii) alteration, e.g., replacement, of a constituent of the ribose or deoxyribose sugar, e.g., of the 2' hydroxyl on the sugar;

(iii) wholesale replacement of the phosphate moiety with "dephospho" linkers;

(iv) modification or replacement of a naturally occurring nucleobase;

(v) replacement or modification of the ribose- or deoxyribose-phosphate backbone;

(vi) modification of the 3' end or 5' end of the oligonucleotide, e.g., removal, modification or replacement of a terminal phosphate group or conjugation of a moiety; and (vii) modification of the sugar.

The modifications listed above can be combined to provide modified nucleosides and nucleotides that can have two, three, four, or more modifications. For example, a modified nucleoside or nucleotide can have a modified sugar and a modified nucleobase. In an embodiment, every base of a gRNA, a template binding domain partner, or template nucleic acid is modified, e.g., all bases have a modified phosphate group, e.g., all are phosphorothioate groups. In an embodiment, all, or substantially all, of the phosphate groups of a unimolecular or modular gRNA molecule, a template binding domain partner, or template nucleic acid are replaced with phosphorothioate groups.

In an embodiment, modified nucleotides, e.g., nucleotides having modifications as described herein, can be incorporated into a nucleic acid, e.g., a "modified nucleic acid." In some embodiments, the modified nucleic acids comprise one, two, three or more modified nucleotides. In some embodiments, at least 5% (e.g., at least about 5%, at least about 10%, at least about 15%, at least about 20%, at least about 25%, at least about 30%, at least about 35%, at least about 40%, at least about 45%, at least about 50%, at least about 55%, at least about 60%, at least about 65%, at least about 70%, at least about 75%, at least about 80%, at least about 85%, at least about 90%, at least about 95%, or about 100%) of the positions in a modified nucleic acid are a modified nucleotides.

Unmodified nucleic acids can be prone to degradation by, e.g., cellular nucleases. For example, nucleases can hydrolyze nucleic acid phosphodiester bonds. Accordingly, in one aspect the modified nucleic acids described herein can contain one or more modified nucleosides or nucleotides, e.g., to introduce stability toward nucleases.

In some embodiments, the modified nucleosides, modified nucleotides, and modified nucleic acids described herein can exhibit a reduced innate immune response when introduced into a population of cells, both in vivo and ex vivo. The term "innate immune response" includes a cellular response to exogenous nucleic acids, including single stranded nucleic acids, generally of viral or bacterial origin, which involves the induction of cytokine expression and release, particularly the interferons, and cell death. In some embodiments, the modified nucleosides, modified nucleotides, and modified nucleic acids described herein can disrupt binding of a major groove interacting partner with the nucleic acid. In some embodiments, the modified nucleosides, modified nucleotides, and modified nucleic acids described herein can exhibit a reduced innate immune response when introduced into a population of cells, both in vivo and ex vivo, and also disrupt binding of a major groove interacting partner with the nucleic acid.

In some embodiments, a template nucleic acid comprises modifications, e.g., modified nucleotides, modifications to the backbone, and other modifications described herein. In some embodiments, the modification improves the stability of the template nucleic acid, e.g., by increasing its resistance to endonucleases and/or exonucleases.

In some embodiments, a template nucleic acid that comprises modifications is double stranded, e.g., is double stranded DNA. In some such embodiments, all the modifications are confined to one strand. In other embodiments, modifications are present on both strands. Modifications may be present in the 5' homology arm, the 3' homology arm, or the replacement sequence, or any combination thereof. In some embodiments, modifications are present in one or both homology arms but not the replacement sequence.

In some embodiments, a template nucleic acid that comprises modifications is single stranded, e.g., is single stranded DNA.

Definitions of Chemical Groups

As used herein, "alkyl" is meant to refer to a saturated hydrocarbon group which is straight-chained or branched. Example alkyl groups include methyl (Me), ethyl (Et), propyl (e.g., n-propyl and isopropyl), butyl (e.g., n-butyl, isobutyl, t-butyl), pentyl (e.g., n-pentyl, isopentyl, neopentyl), and the like. An alkyl group can contain from 1 to about 20, from 2 to about 20, from 1 to about 12, from 1 to about 8, from 1 to about 6, from 1 to about 4, or from 1 to about 3 carbon atoms.

As used herein, "aryl" refers to monocyclic or polycyclic (e.g., having 2, 3 or 4 fused rings) aromatic hydrocarbons such as, for example, phenyl, naphthyl, anthracenyl, phenanthrenyl, indanyl, indenyl, and the like. In some embodiments, aryl groups have from 6 to about 20 carbon atoms.

As used herein, "alkenyl" refers to an aliphatic group containing at least one double bond.

As used herein, "alkynyl" refers to a straight or branched hydrocarbon chain containing 2-12 carbon atoms and characterized in having one or more triple bonds. Examples of alkynyl groups include, but are not limited to, ethynyl, propargyl, and 3-hexynyl.

As used herein, "arylalkyl" or "aralkyl" refers to an alkyl moiety in which an alkyl hydrogen atom is replaced by an aryl group. Aralkyl includes groups in which more than one hydrogen atom has been replaced by an aryl group. Examples of "arylalkyl" or "aralkyl" include benzyl, 2-phenylethyl, 3-phenylpropyl, 9-fluorenyl, benzhydryl, and trityl groups.

As used herein, "cycloalkyl" refers to a cyclic, bicyclic, tricyclic, or polycyclic non-aromatic hydrocarbon groups having 3 to 12 carbons. Examples of cycloalkyl moieties include, but are not limited to, cyclopropyl, cyclopentyl, and cyclohexyl.

As used herein, "heterocyclyl" refers to a monovalent radical of a heterocyclic ring system. Representative heterocyclyls include, without limitation, tetrahydrofuranyl, tetrahydrothienyl, pyrrolidinyl, pyrrolidonyl, piperidinyl, pyrrolinyl, piperazinyl, dioxanyl, dioxolanyl, diazepinyl, oxazepinyl, thiazepinyl, and morpholinyl.

As used herein, "heteroaryl" refers to a monovalent radical of a heteroaromatic ring system. Examples of heteroaryl moieties include, but are not limited to, imidazolyl, oxazolyl, thiazolyl, triazolyl, pyrrolyl, furanyl, indolyl, thiophenyl pyrazolyl, pyridinyl, pyrazinyl, pyridazinyl, pyrimidinyl, indolizinyl, purinyl, naphthyridinyl, quinolyl, and pteridinyl.

Phosphate Backbone Modifications
The Phosphate Group

In some embodiments, the phosphate group of a modified nucleotide can be modified by replacing one or more of the oxygens with a different substituent. Further, the modified nucleotide, e.g., modified nucleotide present in a modified nucleic acid, can include the wholesale replacement of an unmodified phosphate moiety with a modified phosphate as described herein. In some embodiments, the modification of the phosphate backbone can include alterations that result in either an uncharged linker or a charged linker with unsymmetrical charge distribution.

Examples of modified phosphate groups include phosphorothioate, phosphoroselenates, borano phosphates, borano phosphate esters, hydrogen phosphonates, phosphoroamidates, alkyl or aryl phosphonates and phosphotriesters. In some embodiments, one of the non-bridging phosphate oxygen atoms in the phosphate backbone moiety can be replaced by any of the following groups: sulfur (S), selenium (Se), $BR_3$ (wherein R can be, e.g., hydrogen, alkyl, or aryl), C (e.g., an alkyl group, an aryl group, and the like), H, $NR_2$ (wherein R can be, e.g., hydrogen, alkyl, or aryl), or OR (wherein R can be, e.g., alkyl or aryl). The phosphorous atom in an unmodified phosphate group is achiral. However, replacement of one of the non-bridging oxygens with one of the above atoms or groups of atoms can render the phosphorous atom chiral; that is to say that a phosphorous atom in a phosphate group modified in this way is a stereogenic center. The stereogenic phosphorous atom can possess either the "R" configuration (herein Rp) or the "S" configuration (herein Sp).

Phosphorodithioates have both non-bridging oxygens replaced by sulfur. The phosphorus center in the phosphorodithioates is achiral which precludes the formation of oligoribonucleotide (or oligodeoxyribonucleotide) diastereomers. In some embodiments, modifications to one or both non-bridging oxygens can also include the replacement of the non-bridging oxygens with a group independently selected from S, Se, B, C, H, N, and OR (R can be, e.g., alkyl or aryl).

The phosphate linker can also be modified by replacement of a bridging oxygen, (i.e., the oxygen that links the phosphate to the nucleoside), with nitrogen (bridged phosphoroamidates), sulfur (bridged phosphorothioates) and carbon (bridged methylenephosphonates). The replacement can occur at either linking oxygen or at both of the linking oxygens.

Replacement of the Phosphate Group

The phosphate group can be replaced by non-phosphorus containing connectors. In some embodiments, the charge phosphate group can be replaced by a neutral moiety.

Examples of moieties which can replace the phosphate group can include, without limitation, e.g., methyl phosphonate, hydroxylamino, siloxane, carbonate, carboxymethyl, carbamate, amide, thioether, ethylene oxide linker, sulfonate, sulfonamide, thioformacetal, formacetal, oxime, methyleneimino, methylenemethylimino, methylenehydrazo, methylenedimethylhydrazo and methyleneoxymethylimino.

Replacement of the Ribophosphate Backbone

Scaffolds that can mimic nucleic acids can also be constructed wherein the phosphate linker and ribose sugar are replaced by nuclease resistant nucleoside or nucleotide surrogates. In some embodiments, the nucleobases can be tethered by a surrogate backbone. Examples can include, without limitation, the morpholino, cyclobutyl, pyrrolidine and peptide nucleic acid (PNA) nucleoside surrogates.

Sugar Modifications

The modified nucleosides and modified nucleotides can include one or more modifications to the sugar group. For example, the 2' hydroxyl group (OH) can be modified or replaced with a number of different "oxy" or "deoxy" substituents. In some embodiments, modifications to the 2' hydroxyl group can enhance the stability of the nucleic acid since the hydroxyl can no longer be deprotonated to form a 2'-alkoxide ion. The 2'-alkoxide can catalyze degradation by intramolecular nucleophilic attack on the linker phosphorus atom.

Examples of "oxy"-2' hydroxyl group modifications can include alkoxy or aryloxy (OR, wherein "R" can be, e.g., alkyl, cycloalkyl, aryl, aralkyl, heteroaryl or a sugar); polyethyleneglycols (PEG), O(CH2CH2O)nCH2CH2OR wherein R can be, e.g., H or optionally substituted alkyl, and n can be an integer from 0 to 20 (e.g., from 0 to 4, from 0 to 8, from 0 to 10, from 0 to 16, from 1 to 4, from 1 to 8, from 1 to 10, from 1 to 16, from 1 to 20, from 2 to 4, from 2 to 8, from 2 to 10, from 2 to 16, from 2 to 20, from 4 to 8, from 4 to 10, from 4 to 16, and from 4 to 20). In some embodiments, the "oxy"-2' hydroxyl group modification can include "locked" nucleic acids (LNA) in which the 2' hydroxyl can be connected, e.g., by a $C_{1-6}$ alkylene or $C_{1-6}$ heteroalkylene bridge, to the 4' carbon of the same ribose sugar, where exemplary bridges can include methylene, propylene, ether, or amino bridges; O-amino (wherein amino can be, e.g., $NH_2$; alkylamino, dialkylamino, heterocyclyl, arylamino, diarylamino, heteroarylamino, or diheteroarylamino, ethylenediamine, or polyamino) and aminoalkoxy, $O(CH2)_n$-amino, (wherein amino can be, e.g., $NH_2$; alkylamino, dialkylamino, heterocyclyl, arylamino, diarylamino, heteroarylamino, or diheteroarylamino, ethylenediamine, or polyamino). In some embodiments, the "oxy"-2' hydroxyl group modification can include the methoxyethyl group (MOE), (OCH2CH2OCH3, e.g., a PEG derivative).

"Deoxy" modifications can include hydrogen (i.e. deoxyribose sugars, e.g., at the overhang portions of partially ds RNA); halo (e.g., bromo, chloro, fluoro, or iodo); amino (wherein amino can be, e.g., $NH_2$; alkylamino, dialkylamino, heterocyclyl, arylamino, diarylamino, heteroarylamino, diheteroarylamino, or amino acid);

$NH(CH_2CH_2NH)_nCH_2CH_2$-amino (wherein amino can be, e.g., as described herein), —NHC(O)R (wherein R can be, e.g., alkyl, cycloalkyl, aryl, aralkyl, heteroaryl or sugar), cyano; mercapto; alkyl-thio-alkyl; thioalkoxy; and alkyl, cycloalkyl, aryl, alkenyl and alkynyl, which may be optionally substituted with e.g., an amino as described herein.

The sugar group can also contain one or more carbons that possess the opposite stereochemical configuration than that of the corresponding carbon in ribose. Thus, a modified nucleic acid can include nucleotides containing e.g., arabinose, as the sugar. The nucleotide "monomer" can have an alpha linkage at the 1' position on the sugar, e.g., alpha-nucleoside s. The modified nucleic acids can also include "abasic" sugars, which lack a nucleobase at C-1'. These abasic sugars can also be further modified at one or more of the constituent sugar atoms. The modified nucleic acids can also include one or more sugars that are in the L form, e.g. L-nucleosides.

Generally, RNA includes the sugar group ribose, and DNA includes the sugar group deoxyribose, each of which is a 5-membered ring having an oxygen. Exemplary modified nucleosides and modified nucleotides can include, without limitation, replacement of the oxygen in the ribose or deoxyribose ring (e.g., with sulk (S), selenium (Se), or alkylene, such as, e.g., methylene or ethylene); addition of a double bond (e.g., to replace ribose with cyclopentenyl or cyclohexenyl); ring contraction of ribose (e.g., to form a 4-membered ring of cyclobutane or oxetane); ring expansion of ribose (e.g., to form a 6- or 7-membered ring having an additional carbon or heteroatom, such as for example, anhydrohexitol, altritol, mannitol, cyclohexanyl, cyclohexenyl, and morpholino that also has a phosphoramidate backbone). In some embodiments, the modified nucleotides can include multicyclic forms (e.g., tricyclo; and "unlocked" forms, such as glycol nucleic acid (GNA) (e.g., R-GNA or 5-GNA, where ribose is replaced by glycol units attached to phosphodiester bonds), threose nucleic acid (TNA, where ribose is replaced with α-L-threofuranosyl-(3'→2')).

Modifications on the Nucleobase

The modified nucleosides and modified nucleotides described herein, which can be incorporated into a modified nucleic acid, can include a modified nucleobase. Examples of nucleobases include, but are not limited to, adenine (A), guanine (G), cytosine (C), and uracil (U). These nucleobases can be modified or wholly replaced to provide modified nucleosides and modified nucleotides that can be incorporated into modified nucleic acids. The nucleobase of the nucleotide can be independently selected from a purine, a pyrimidine, a purine or pyrimidine analog. In some embodiments, the nucleobase can include, for example, naturally-occurring and synthetic derivatives of a base.

Uracil

In some embodiments, the modified nucleobase is a modified uracil. Exemplary nucleobases and nucleosides having a modified uracil include without limitation pseudouridine (ψ), pyridin-4-one ribonucleoside, 5-aza-uridine, 6-aza-uridine, 2-thio-5-aza-uridine, 2-thio-uridine (s2U), 4-thio-uridine (s4U), 4-thio-pseudouridine, 2-thio-pseudouridine, 5-hydroxy-uridine (ho$^5$U), 5-aminoallyl-uridine, 5-halo-uridine (e.g., 5-iodo-uridine or 5-bromo-uridine), 3-methyl-uridine (m$^3$U), 5-methoxy-uridine (mo$^5$U), uridine 5-oxyacetic acid (cmo$^5$U), uridine 5-oxyacetic acid methyl ester (mcmo$^5$U), 5-carboxymethyl-uridine (cm$^5$U), 1-carboxymethyl-pseudouridine, 5-carboxyhydroxymethyl-uridine (chm$^5$U), 5-carboxyhydroxymethyl-uridine methyl ester (mchm$^5$U), 5-methoxycarbonylmethyl-uridine (mcm$^5$U), 5-methoxycarbonylmethyl-2-thio-uridine (mcm$^5$s2U), 5-aminomethyl-2-thio-uridine (nm$^5$s2U), 5-methylaminomethyl-uridine (mnm$^5$U), 5-methylaminomethyl-2-thio-uridine (mnm$^5$s2U), 5-methylaminomethyl-2-seleno-uridine (mnm$^5$se$^2$U), 5-carbamoylmethyl-uridine (ncm$^5$U), 5-carboxymethylaminomethyl-uridine (cmnm$^5$U), 5-carboxymethylaminomethyl-2-thio-uridine (cmnm$^5$s2U), 5-propynyl-uridine, 1-propynyl-pseudouridine, 5-taurinomethyl-uridine (τcm$^5$U), 1-taurinomethyl-pseudouridine, 5-taurinomethyl-2-thio-uridine(τm$^5$s2U), 1-taurinomethyl-4-thio-pseudouridine, 5-methyl-uridine (m$^5$U, i.e., having the nucleobase deoxythymine), 1-methyl-pseudouridine (m$^1$ψ), 5-methyl-2-thio-uridine (m$^5$s2U), 1-methyl-4-thio-pseudouridine (m$^1$s$^4$ψ), 4-thio-1-methyl-pseudouridine, 3-methyl-pseudouridine (m$^3$ψ), 2-thio-1-methyl-pseudouridine, 1-methyl-1-deaza-pseudouridine, 2-thio-1-methyl-1-deaza-pseudouridine, dihydrouridine (D), dihydropseudouridine, 5,6-dihydrouridine, 5-methyl-dihydrouridine (m$^5$D), 2-thio-dihydrouridine, 2-thio-dihydropseudouridine, 2-methoxy-uridine, 2-methoxy-4-thio-uridine, 4-methoxy-pseudouridine, 4-methoxy-2-thio-pseudouridine, N1-methyl-pseudouridine, 3-(3-amino-3-carboxypropyl) uridine (acp$^3$U), 1-methyl-3-(3-amino-3-carboxypropyl) pseudouridine (acp$^3$ψ), 5-(isopentenylaminomethyl)uridine (inm$^5$U), 5-(isopentenylaminomethyl)-2-thio-uridine (inm$^5$s2U), α-thio-uridine, 2'-O-methyl-uridine (Um), 5,2'-O-dimethyl-uridine (m$^5$Um), 2'-O-methyl-pseudouridine (ψm), 2-thio-2'-O-methyl-uridine (s2Um), 5-methoxycarbonylmethyl-2'-methyl-uridine (mcm $^5$Um), 5-carbamoylmethyl-2'-O-methyl-uridine (ncm $^5$Um), 5-carboxymethyl-aminomethyl-2'-O-methyl-uridine (cmnm $^5$Um), 3,2'-O-dimethyl-uridine (m$^3$Um), 5-(isopentenylaminomethyl)-2'-O-methyl-uridine (inm $^5$Um), 1-thio-uridine, deoxythymidine, 2'-F-ara-uridine, 2'-F-uridine, 2'-0H-ara-uridine, 5-(2-carbomethoxyvinyl) uridine, 5-[3-(1-E-propenylamino)uridine, pyrazolo[3,4-d]pyrimidines, xanthine, and hypoxanthine.

Thymine

In some embodiments, the modified nucleobase is a modified thymine. Thymine differs from uracil in that thymine has a methyl group on carbon 5 of the 6-carbon ring, while uracil has a hydrogen in that position. In some embodiments, the modified thymine is derived from one of the modified uracils described in the previous paragraph, but having said methyl group instead of a hydrogen.

Cytosine

In some embodiments, the modified nucleobase is a modified cytosine. Exemplary nucleobases and nucleosides having a modified cytosine include without limitation 5-aza-cytidine, 6-aza-cytidine, pseudoisocytidine, 3-methyl-cytidine (m$^3$C), N4-acetyl-cytidine (act), 5-formyl-cytidine (f$^5$C), N4-methyl-cytidine (m$^4$C), 5-methyl-cytidine (m$^5$C), 5-halo-cytidine (e.g., 5-iodo-cytidine), 5-hydroxymethyl-cytidine (hm$^5$C), 1-methyl-pseudoisocytidine, pyrrolo-cytidine, pyrrolo-pseudoisocytidine, 2-thio-cytidine (s2C), 2-thio-5-methyl-cytidine, 4-thio-pseudoisocytidine, 4-thio-1-methyl-pseudo isocytidine, 4-thio-1-methyl-1-deaza-pseudoisocytidine, 1-methyl-1-deaza-pseudoisocytidine, zebularine, 5-aza-zebularine, 5-methyl-zebularine, 5-aza-2-thio-zebularine, 2-thio-zebularine, 2-methoxy-cytidine, 2-methoxy-5-methyl-cytidine, 4-methoxy-pseudoisocytidine, 4-methoxy-1-methyl-pseudoisocytidine, lysidine (k$^2$C), α-thio-cytidine, 2'-O-methyl-cytidine (Cm), 5,2'-O-dimethyl-cytidine (m$^5$Cm), N4-acetyl-2'-O-methyl-cytidine (ac$^4$Cm), N4,2'-O-dimethyl-cytidine (m$^4$Cm), 5-formyl-2'-O-methyl-cytidine (f$^5$Cm), N4,N4,2'-O-trimethyl-cytidine (m$^4_2$Cm), 1-thio-cytidine, 2'-F-ara-cytidine, 2'-F-cytidine, and 2'-OH-ara-cytidine.

Adenine

In some embodiments, the modified nucleobase is a modified adenine. Exemplary nucleobases and nucleosides having a modified adenine include without limitation 2-amino-purine, 2,6-diaminopurine, 2-amino-6-halo-purine (e.g., 2-amino-6-chloro-purine), 6-halo-purine (e.g., 6-chloro-purine), 2-amino-6-methyl-purine, 8-azido-adenosine, 7-deaza-adenine, 7-deaza-8-aza-adenine, 7-deaza-2-amino-purine, 7-deaza-8-aza-2-amino-purine, 7-deaza-2,6-diaminopurine, 7-deaza-8-aza-2,6-diaminopurine, 1-methyl-adenosine (m$^1$A), 2-methyl-adenine (m$^2$A), N6-methyl-adenosine (m$^6$A), 2-methylthio-N6-methyl-adenosine (ms2 m$^6$A), N6-isopentenyl-adenosine (i$^6$A), 2-methylthio-N6-isopentenyl-adeno sine (ms$^2$i$^6$A), N6-(cis-hydroxyisopentenyl) adenosine (io$^6$A), 2-methylthio-N6-(cis-hydroxyisopentenyl)adenosine (ms2io$^6$A), N6-glycinylcarbamoyl-adenosine (g$^6$A), N6-threonylcarbamoyl-adenosine (t$^6$A), N6-methyl-N6-threonylcarbamoyl-adenosine (m$^6$t$^6$A), 2-methylthio-N6-threonylcarbamoyl-adenosine (ms$^2$g$^6$A), N6,N6-dimethyl-adenosine (m$^6$2 A), N6-hydroxynorvalylcarbamoyl-adenosine (hn$^6$A), 2-methylthio-N6-hydroxynorvalylcarbamoyl-adenosine (ms2hn$^6$A), N6-acetyl-adenosine (ac$^6$A), 7-methyl-adenine, 2-methylthio-adenine, 2-methoxy-adenine, α-thio-adenosine, 2'-O-methyl-adenosine (Am), N$^6$,2'-O-dimethyl-adenosine (m$^6$Am), N$^6$-Methyl-2'-deoxyadenosine, N6,N6,2'-O-trimethyl-adenosine (m$^6$ 2 Am), 1,2'-O-dimethyl-adenosine (m$^1$Am), 2'-O-ribosyladenosine (phosphate) (Ar (p)), 2-amino-N6-methyl-purine, 1-thio-adenosine, 8-azido-adenosine, 2'-F-ara-adenosine, 2'-F-adenosine, 2'-OH-ara-adenosine, and N6-(19-amino-pentaoxanonadecyl)-adenosine.

Guanine

In some embodiments, the modified nucleobase is a modified guanine. Exemplary nucleobases and nucleosides having a modified guanine include without limitation inosine (I), 1-methyl-inosine (m$^1$I), wyosine (imG), methyl-wyosine (mimG), 4-demethyl-wyosine (imG-14), isowyosine (imG2), wybutosine (yW), peroxywybutosine (o$_2$yW), hydroxywybuto sine (OHyW), undermodified hydroxywybutosine (OHyW*), 7-deaza-guanosine, queuosine (Q), epoxyqueuosine (oQ), galactosyl-queuosine (galQ), mannosyl-queuosine (manQ), 7-cyano-7-deaza-guanosine (preQ$_0$), 7-aminomethyl-7-deaza-guanosine (preQ$_1$), archaeosine (G$^+$), 7-deaza-8-aza-guanosine, 6-thio-guanosine, 6-thio-7-deaza-guanosine, 6-thio-7-deaza-8-aza-guanosine, 7-methyl-guanosine (m$^7$G), 6-thio-7-methyl-guanosine, 7-methyl-inosine, 6-methoxy-guanosine, 1-methyl-guanosine (m'G), N2-methyl-guanosine (m$^2$G), N2,N2-dimethyl-guanosine (m$^2$ $_2$G), N2,7-dimethyl-guanosine (m$^2$,7G), N2, N2,7-dimethyl-guanosine (m$^2$,2,7G), 8-oxo-guanosine, 7-methyl-8-oxo-guanosine, 1-meth thio-guanosine, N2-methyl-6-thio-guanosine, N2,N2-dimethyl-6-thio-guanosine, α-thio-guanosine, 2'-O-methyl-guanosine (Gm), N2-methyl-2'-O-methyl-guanosine (m$^2$Gm), N2,N2-dimethyl-2'-O-methyl-guanosine (m$^2$ $_2$Gm), 1-methyl-2'-O-methyl-guanosine (m'Gm), N2,7-dimethyl-2'-O-methyl-guanosine (m$^2$,7Gm), 2'-O-methyl-inosine (Im), 1,2'-O-dimethyl-inosine (m'Im), O$^6$-phenyl-2'-deoxyinosine, 2'-O-ribosylguanosine (phosphate) (Gr(p)), 1-thio-guanosine, O$^6$-methyl-guanosine, O$^6$-Methyl-2'-deoxyguanosine, 2'-F-ara-guanosine, and 2'-F-guanosine.

Modified gRNAs

In some embodiments, the modified nucleic acids can be modified gRNAs. In some embodiments, gRNAs can be modified at the 3' end. In this embodiment, the gRNAs can be modified at the 3' terminal U ribose. For example, the two terminal hydroxyl groups of the U ribose can be oxidized to aldehyde groups and a concomitant opening of the ribose ring to afford a modified nucleoside as shown below:

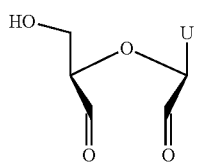

wherein "U" can be an unmodified or modified uridine.

In another embodiment, the 3' terminal U can be modified with a 2'3' cyclic phosphate as shown below:

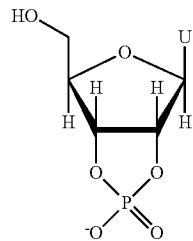

wherein "U" can be an unmodified or modified uridine.

In some embodiments, the gRNA molecules may contain 3' nucleotides which can be stabilized against degradation, e.g., by incorporating one or more of the modified nucleotides described herein. In this embodiment, e.g., uridines can be replaced with modified uridines, e.g., 5-(2-amino)propyl uridine, and 5-bromo uridine, or with any of the modified uridines described herein; adenosines and guanosines can be replaced with modified adenosines and guanosines, e.g., with modifications at the 8-position, e.g., 8-bromo guanosine, or with any of the modified adenosines or guanosines described herein. In some embodiments, deaza nucleotides, e.g., 7-deaza-adenosine, can be incorporated into the gRNA. In some embodiments, O- and N-alkylated nucleotides, e.g., N6-methyl andenosine, can be incorporated into the gRNA. In some embodiments, sugar-modified ribonucleotides can be incorporated, e.g., wherein the 2' OH-group is replaced by a group selected from H, —OR, —R (wherein R can be, e.g., alkyl, cycloalkyl, aryl, aralkyl, heteroaryl or sugar), halo, —SH, —SR (wherein R can be, e.g., alkyl, cycloalkyl, aryl, aralkyl, heteroaryl or sugar), amino (wherein amino can be, e.g., $NH_2$; alkylamino, dialkylamino, heterocyclyl, arylamino, diarylamino, heteroarylamino, diheteroarylamino, or amino acid); or cyano (—CN). In some embodiments, the phosphate backbone can be modified as described herein, e.g., with a phosphothioate group. In some embodiments, the nucleotides in the overhang region of the gRNA can each independently be a modified or unmodified nucleotide including, but not limited to 2'-sugar modified, such as, 2-F 2'-O-methyl, thymidine (T), 2'-O-methoxyethyl-5-methyluridine (Teo), 2'-O-methoxyethyladenosine (Aeo), 2'-O-methoxyethyl-5-methylcytidine (m5 Ceo), and any combinations thereof.

In an embodiment, one or more or all of the nucleotides in single stranded RNA molecule, e.g., a gRNA molecule, are deoxynucleotides.

Modified Nucleic Acid Template Systems

In some embodiments, the nucleic acid template system comprises chemical modifications. These modifications may, e.g., increase the stability or half-life of the nucleic acid or reduce the innate immune response to the nucleic acid. In some embodiments, the template binding domain partner comprises chemical modifications; in some embodiments the template nucleic acid comprises chemical modifications; and in some embodiments, both the template binding domain partner and the template nucleic acid comprise chemical modifications.

In some embodiments, the nucleic acid template system can be modified at one or two 3' ends. In this embodiment, the nucleic acid template system can be modified at the 3' nucleotide. For example, the two terminal hydroxyl groups of the 3'-most sugar can be oxidized to aldehyde groups and a concomitant opening of the ring to afford a modified nucleoside, analogous to the first ribonucleotide shown in the previous section entitled "Modified gRNAs".

In another embodiment, the 3' terminal sugar can be modified with a 2'3' cyclic phosphate, analogous to the second ribonucleotide shown in the previous section entitled "Modified gRNAs".

In some embodiments, the nucleic acid template system may contain 3' nucleotides which can be stabilized against degradation, e.g., by incorporating one or more of the modified nucleotides described herein. In this embodiment, e.g., thymines can be replaced with any of the modified thymines described herein; adenosines and guanosines can be replaced with modified adenosines and guanosines, e.g., with modifications at the 8-position, e.g., 8-bromo guanosine, or with any of the modified adenosines or guanosines described herein. In some embodiments, deaza nucleotides, e.g., 7-deaza-adenosine, can be incorporated into the nucleic acid template system. In some embodiments, O- and N-alkylated nucleotides, e.g., N6-methyl andenosine, can be incorporated into the nucleic acid template system. In some embodiments, sugar-modified deoxyribonucleotides can be incorporated, e.g., wherein the 2' H-group is replaced by a group selected from OH, —OR, -R (wherein R can be, e.g., alkyl, cycloalkyl, aryl, aralkyl, heteroaryl or sugar), halo, —SH, —SR (wherein R can be, e.g., alkyl, cycloalkyl, aryl, aralkyl, heteroaryl or sugar), amino (wherein amino can be, e.g., $NH_2$; alkylamino, dialkylamino, heterocyclyl, arylamino, diarylamino, heteroarylamino, diheteroarylamino, or amino acid); or cyano (—CN). In some embodiments, the phosphate backbone can be modified as described herein, e.g., with a phosphothioate group. In some embodiments, the nucleic acid template system comprises an overhang region, and the nucleotides in the overhang region can each independently be a modified or unmodified nucleotide including, but not limited to 2'-sugar modified, such as, 2-F 2'-O-methyl, 2'-O-methoxyethyl-5-methyluridine (Teo), 2'-O-methoxyethyladenosine (Aeo), 2'-O-methoxyethyl-5-methylcytidine (m5Ceo), and any combinations thereof.

miRNA Binding Sites

MicroRNAs (miRNAs) are naturally occurring cellular 19-25 nucleotide long noncoding RNAs. They bind to nucleic acid molecules having an appropriate miRNA binding site, e.g., in the 3' UTR of an mRNA, and down-regulate gene expression. While not wishing to be bound by theory it is believed that the down regulation is either by reducing nucleic acid molecule stability or by inhibiting translation. An RNA species disclosed herein, e.g., an mRNA encoding Cas9 fusion molecule can comprise an miRNA binding site, e.g., in its 3'UTR. The miRNA binding site can be selected to promote down regulation of expression is a selected cell type. By way of example, the incorporation of a binding site for miR-122, a microRNA abundant in liver, can inhibit the expression of the gene of interest in the liver.

XII. Nucleic Acids; Kits; Methods of Production

In some aspects, disclosed herein is a nucleic acid, e.g., an isolated or non-naturally occurring nucleic acid, e.g., DNA, that comprises a sequence that encodes a gRNA molecule comprising a targeting domain that is complementary with a target domain as disclosed herein. In an embodiment, the nucleic acid encodes a gRNA molecule, e.g., a first gRNA molecule, comprising a targeting domain configured to provide a cleavage event, e.g., a double strand break or a single strand break, sufficiently close to a region desired to be altered to allow alteration, e.g., alteration associated with HDR of the region desired to be altered.

A nucleic acid disclosed herein may comprise (a) a sequence that encodes a gRNA molecule comprising a targeting domain that is complementary with a target domain as disclosed herein; (b) a sequence that encodes a Cas9 fusion molecule; and further comprises (c) (i) a sequence that encodes a second gRNA molecule described herein having a targeting domain that is complementary to a second target domain, and optionally, (ii) a sequence that encodes a third gRNA molecule described herein having a targeting domain that is complementary to a third target domain; and optionally, (iii) a sequence that encodes a fourth gRNA molecule described herein having a targeting domain that is complementary to a fourth target domain.

In some embodiments, when a region that is desired to be altered is corrected by HDR, the nucleic acid encodes (a) a sequence that encodes a gRNA molecule comprising a targeting domain that is complementary with a target domain gene as disclosed herein; (b) a sequence that encodes a Cas9 fusion molecule; (c) a template nucleic acid, (d) a template binding domain, and (e) a template binding domain partner.

In some embodiments, one or more of e.g., all of (a), (b), (c), (d), and (e) are present on the same nucleic acid molecule, e.g., the same vector, e.g., the same viral vector, e.g., the same adeno-associated virus (AAV) vector. In an embodiment, the nucleic acid molecule is an AAV vector. Exemplary AAV vectors that may be used in any of the described compositions and methods include an AAV2 vector, a modified AAV2 vector, an AAV3 vector, a modified AAV3 vector, an AAV6 vector, a modified AAV6 vector, an AAV8 vector and an AAV9 vector.

In other embodiments, a subset of (a), (b), (c), (d), and (e) is present on a first nucleic acid molecule, e.g. a first vector, e.g., a first viral vector, e.g., a first AAV vector; and the remainder of (a), (b), (c), (d), and (e) is present on a second nucleic acid molecule, e.g., a second vector, e.g., a second vector, e.g., a second AAV vector. The first and second nucleic acid molecules may be AAV vectors. In many embodiments, the Cas9 fusion molecule of (b) and the template binding domain of (d) are present on the same nucleic acid molecule, e.g., a viral vector, e.g., an AAV vector. In many embodiments, the template nucleic acid of (c) and the template binding domain partner of (e) are present on the same nucleic acid molecule, e.g., a viral vector, e.g., an AAV vector.

In some embodiments, all of (a), (b), (c), (d), and (e) are on the same vector, e.g., the same AAV vector. In some embodiments, all of (a), (b), (c), (d), and (e) are on different vectors, e.g., one or more AAV vectors. In some embodiments, two or more, e.g., two, three, or four of (a), (b), (c), (d), and (e) are on the same vector, e.g., an AAV vector, and the remainder are on one or more other vectors, e.g., one or more AAV vectors. In some embodiments, (a) and (b) are on the same vector, e.g., an AAV vector; (a) and (c) are on the same vector, e.g., an AAV vector, (a) and (d) are on the same vector, e.g., an AAV vector, (b) and (c) are on the same vector, e.g., an AAV vector, (b) and (d) are on the same vector, e.g., an AAV vector, or (c) and (d) are on the same vector, e.g., an AAV vector.

The nucleic acids described herein may comprise a promoter operably linked to the sequence that encodes the gRNA molecule of (a), e.g., a promoter described herein. The nucleic acid may further comprise a second promoter operably linked to the sequence that encodes the second, third and/or fourth gRNA molecule of (e), e.g., a promoter described herein. The promoter and second promoter differ from one another. In some embodiments, the promoter and second promoter are the same.

The nucleic acids described herein may further comprise a promoter operably linked to the sequence that encodes the Cas9 fusion molecule of (b), e.g., a promoter described herein.

The nucleic acids described herein may further comprise a promoter operably linked to the sequence that encodes the template binding domain of (d), e.g., a promoter described herein. In some embodiments, the template binding domain of (d) and the Cas9 fusion molecule of (b) are controlled by the same promoter, e.g., they can form a fusion protein.

In another aspect, disclosed herein is a kit comprising one or more, e.g., all of the following:
(a) gRNA molecule described herein, or nucleic acid that encodes the gRNA;
(b) a Cas9 fusion molecule, e.g., a Cas9 fusion molecule described herein, or a nucleic acid or mRNA that encodes the Cas9 fusion molecule;
(c) a template nucleic acid; and
(d) a template binding domain, and
(e) a template binding domain partner.

In an embodiment, the kit comprises a nucleic acid comprising both (c) and (e).

In an embodiment, the kit comprises nucleic acid, e.g., an AAV vector, that encodes one or more of (a), (b), (c), (d), and (e).

XIII. Methods of Treatment

A genetic disease is caused by a mutation in the patient's genome. Often, the mutation results in a change in a protein, e.g., an amino acid substitution or a truncation. Genetic diseases can be dominant, i.e., one mutant gene is sufficient to cause the disease, or recessive, where a patient with one copy of the mutant gene is an asymptomatic carrier, and two copies of the mutant gene are necessary for the disease to result.

Disclosed herein are the approaches to treat or prevent genetic diseases, using the compositions and methods described herein.

One approach to treat or prevent genetic diseases is to repair (i.e., correct) one or more mutations in the disease-causing gene by HDR. In this approach, mutant allele(s) are corrected and restored to wild type state. While not wishing to be bound by theory, it is believed that correction of the mutation to the corresponding wild-type sequence restores wild type protein production within the relevant cell type. The method described herein can be performed in all cell types.

In an embodiment, one mutant allele is repaired in the subject. For example, in a patient with an autosomal dominant genetic disease, the sole mutant allele in the cell is corrected so that the cell becomes wild-type at both loci. As another example, in a patient with an autosomal recessive genetic disease, one of the two mutant alleles in the cell is corrected, and so the cell becomes heterozygous, which is sufficient for normal functioning. As a recessive genetic disease only displays a phenotype when both alleles are mutated, repair of a single allele is adequate for a cure. In another embodiment, both mutant alleles are repaired in the subject. In either situation, the subjects can be cured of disease.

Correction of a mutation in the relevant gene may be performed prior to disease onset (e.g., prior to the appearance of symptoms) or after disease onset, for instance, early in the disease course.

In an embodiment, the method comprises initiating treatment of a subject prior to disease onset. In an embodiment, the method comprises initiating treatment of a subject after disease onset. In an embodiment, the method comprises initiating treatment of a subject well after disease onset, e.g., 1, 2, 3, 4, 5, 6, 7, 8, 9, 10, 12, 24, or 36 months after onset of the disease. While not wishing to be bound by theory it is believed that this may be effective if subjects did not present to physician until well into the course of illness.

In an embodiment, the method comprises initiating treatment of a subject in an advanced stage of disease.

Overall, initiation of treatment for subjects at all stages of disease is expected to prevent negative consequences of disease and be of benefit to subjects.

In an embodiment, the method comprises initiating treatment of a subject prior to disease expression. In an embodiment, the method comprises initiating treatment of a subject in an early stage of disease, e.g., when a subject has tested positive for the disease but has no signs or symptoms associated with the disease.

In an embodiment, the method comprises initiating treatment of a subject who has tested positive for the mutation underlying the disease, based on diagnosis via electrophoresis, genotyping, family history or other diagnostic criteria.

EXAMPLES

The following Examples are merely illustrative and are not intended to limit the scope or content of the invention in any way.

Example 1: Enhancing HDR-Mediated Alteration of a Target Nucleic Acid in Cultured Cells Using a Cas9 Fusion Protein This study demonstrates an increased rate of HDR-mediated nucleic acid modification at a target site in cultured cells by administering to the cells a Cas9 fusion protein, one or more gRNAs, and an HDR donor nucleic acid template. The Cas9 fusion protein is a Cas9 protein fused to a polypeptide comprising the DNA binding domain derived from a sequence-specific DNA binding protein, e.g., one of the DNA binding proteins listed in Tables V.1-V.4 of Section V, above. The Cas9 fusion protein (or, in control cells, Cas9 protein lacking the fusion domain) is administered as a DNA expression vector, an mRNA or a protein. The one or more gRNAs are administered as DNA expression vectors or RNA molecules. The donor template is provided as a plasmid DNA, a linear double-stranded DNA, a single-stranded oligonucleotide or viral genomic DNA, as described above, e.g., in FIGS. 1-4. The donor template contains one or more copies of a nucleotide sequence that can be bound by the sequence-specific DNA binding domain that is fused to the Cas9 polypeptide. The Cas9 fusion protein (or control Cas9), gRNAs and donor template are introduced into the cells by methods known in the art, such as viral transduction, non-viral transfection or electroporation.

At various time points, cells are harvested in order to assess the rate of nucleic acid modification by HDR. This is achieved by 1) isolating genomic DNA from the Cas9 control and Cas9 fusion protein treated cells; 2) PCR amplifying the DNA encompassing the region targeted for modification; 3) sequencing the amplified DNA products; and 4) determining the frequency of HDR-mediated alteration by dividing the number of sequence reads containing the donor template-specified sequence by the total number of sequence reads comprising the targeted region. Treatment of cells with a Cas9 fusion protein is shown to increase the rate of HDR-mediated nucleic acid modification.

Example 2: Enhancing HDR-Mediated Alteration of a Target Nucleic Acid in a Tissue of an Animal Using a Cas9 Fusion Protein This study demonstrates an increased rate of HDR-mediated nucleic acid modification at a target site in a tissue of an animal by administering to the animal a Cas9 fusion protein, one or more gRNAs, and a nucleic acid template system, e.g., an HDR donor nucleic acid template. The Cas9 fusion protein is a Cas9 protein fused to a polypeptide comprising the DNA binding domain derived from a sequence-specific DNA binding protein, e.g. one of the DNA binding proteins listed in Tables V.1-V.4 of Section V, above. The Cas9 fusion protein (or, in a control cohort of animals, Cas9 protein lacking the fusion domain) is administered as a DNA expression vector, an mRNA or a protein. The one or more gRNAs are administered as DNA expression vectors or RNA molecules. The donor template is provided as a plasmid DNA, a linear double-stranded DNA, a single-stranded oligonucleotide or viral genomic DNA, as described above, e.g., in FIGS. 1-4. The donor template contains one or more copies of a nucleotide sequence that can be bound by the sequence-specific DNA binding domain that is fused to the Cas9 polypeptide. The Cas9 fusion protein (or control Cas9), gRNAs and nucleic acid template system are introduced into the animal by local or systemic administration of viral vectors or non-viral delivery vehicles.

At various time points, tissues are harvested in order to assess the rate of nucleic acid modification by HDR. This is achieved by 1) isolating genomic DNA from the Cas9 control and Cas9 fusion protein treated cells; 2) PCR amplifying the DNA encompassing the region targeted for modification; 3) sequencing the amplified DNA products; and 4) determining the frequency of HDR-mediated alteration by dividing the number of sequence reads containing the donor template-specified sequence by the total number of sequence reads comprising the targeted region. Treatment of cells with a Cas9 fusion protein is shown to increase the rate of HDR-mediated nucleic acid modification.

Example 3: Constructing a Cas9 Fusion Protein

To generate a Cas9 fusion protein, established molecular biology techniques are used to ligate a nucleotide sequence encoding a DNA binding domain derived from a sequence-specific DNA binding protein, e.g., one of the DNA binding proteins listed in Tables V.1-V.4 of Section V, above, in-frame to a nucleotide sequence encoding a Cas9 protein. A nucleotide sequence encoding a linker peptide may be inserted in-frame between the nucleotide sequences encoding the Cas9 protein and the DNA binding domain. For expression in bacteria, cultured cells, or animal tissues, the nucleotide sequence encoding the Cas9-DNA binding domain fusion molecule is operably linked to one or more transcriptional control elements, e.g., promoter and/or enhancer elements, which enable expression in the relevant bacteria, cultured cells, or animal tissue. The Cas9 fusion protein can be purified from the bacteria, cultured cells, or animal tissue using established biochemical techniques. To generate mRNA encoding the Cas9 fusion protein, the nucleotide sequence encoding the Cas9-DNA binding were sufficient for binding of the Tet repressor protein, and whether shrinking the spacer sequence would still allow for efficient Tet repressor protein binding. The conditions tested (including the sequences) are indicated in Table 8, and visually depicted in FIG. 8A.

TABLE 8

| Template DNA ID | Description | SEQ ID NO | Sequence |
|---|---|---|---|
| ssODN-179 (control) | ssODN-179 | 162 | TGCTTCTGACACAACTGTGTTCACTAGCAA CCTCAAACAGACACCATGGTGCATCTGACT CGTGTGGAGAAGTCGGCCGTTACTGCCCTG CAGGGCAAGCTTAACGTGGATGAAGTTCGT GGTGAGGCCCTGGGCAGGTTGGTATCAAGG TTACAAGACAGGTTTAAGGAGACCAATAG |
| ssODN-109 (control) | ssODN-109 | 163 | AACAGACACCATGGTGCATCTGACTCGTGT GGAGAAGTCGGCCGTTACTGCCCTGCAGGG CAAGCTTAACGTGGATGAAGTTCGTGGTGA GGCCCTGGGCAGGTTGGTA |
| V1.1 | (3xTetO, 17 bp spacer)-ssODN-109 | 164 | TCCCTATCAGTGATAGAGAACGTATGTCGA GTTTACTCCCTATCAGTGATAGAGAACGTA TGTCGAGTTTACTCCCTATCAGTGATAGAG AAACAGACACCATGGTGCATCTGACTCGTG TGGAGAAGTCGGCCGTTACTGCCCTGCAGG GCAAGCTTAACGTGGATGAAGTTCGTGGTG AGGCCCTGGGCAGGTTGGTA |
| V1.2 | ssODN-109-(3xTetO, 17 bp spacer) | 165 | AACAGACACCATGGTGCATCTGACTCGTGT GGAGAAGTCGGCCGTTACTGCCCTGCAGGG CAAGCTTAACGTGGATGAAGTTCGTGGTGA GGCCCTGGGCAGGTTGGTATCCCTATCAGT GATAGAGAACGTATGTCGAGTTTACTCCCT ATCAGTGATAGAGAACGTATGTCGAGTTTA CTCCCTATCAGTGATAGAGA |
| V2 | (3xTetO, 8 bp spacer)-ssODN-109 | 166 | TCCCTATCAGTGATAGAGAACGTATGTTCC CTATCAGTGATAGAGAACGTATGTTCCCTA TCAGTGATAGAGAACGTATGTAACAGACAC CATGGTGCATCTGACTCGTGTGGAGAAGTC GGCCGTTACTGCCCTGCAGGGCAAGCTTAA CGTGGATGAAGTTCGTGGTGAGGCCCTGGG CAGGTTGGTA |
| V3 | (3xTetO, no spacer)-ssODN-109 | 167 | TCCCTATCAGTGATAGAGATCCCTATCAGT GATAGAGATCCCTATCAGTGATAGAGAAAC AGACACCATGGTGCATCTGACTCGTGTGGA GAAGTCGGCCGTTACTGCCCTGCAGGGCAA GCTTAACGTGGATGAAGTTCGTGGTGAGGC CCTGGGCAGGTTGGTA | domain fusion is operably linked to a promoter, e.g., a bacteriophage promoter, e.g., a T7 RNA polymerase promoter enabling in vitro transcription of mRNA encoding the Cas9-DNA binding domain fusion molecule.

Example 4: Optimization of the Tet Repressor Binding Domain

In this study, the Tet Repressor (TetR) Operon system was selected the optimal composition of the template binding domain partner assessed to achieve strong binding and ensure sufficient length of a locus-specific DNA donor.

The nucleotide sequence to which the Tet Repressor protein binds, typically consists of several repeats (5 or more) of the Tet Operator (TetO)19 base pair sequence, each followed by a 17 bp spacer. Here, we evaluated the binding of the Tet repressor protein to several Tet Operator sequence-containing variants that included spacer sequences of differing sizes, or no spacer sequences. Specifically, we investigated whether only 3 repeats of the Tet Operator sequence To test the binding capacity of the Tet Operator sequence-containing variants experimentally, 500 nM of recombinant TetR protein (Imgen BioSciences, Inc.; Cat. No. P-1002-0.5 mg) was incubated with 50 nM of template DNA in binding buffer (50 mM HEPES, 20% glycerol, 300 mM NaCl, pH 7.7) and protein binding to the Tet Operator sequence-containing variants was analyzed using an electrophoretic mobility shift assay using a 10% polyacrylamide gel (FIG. 8B).

As expected, no gel shift was observed for control templates lacking the Tet operator sequence (ssODN-179, ssODN109). In contrast, complete gel shift (indicating binding of Tet repressor protein to the Tet Operator sequence) was observed for templates V1.1, V1.2, and V2. Moreover, partial gel shift was observed for template V3, indicating some, but not complete, binding of TetR protein. These data indicate that Tet Operator sequences separated by a shorter 8 bp spacer are indeed functional, and that three Tet Operator repeats are sufficient for Tet Repressor protein binding to occur. Based on these results, novel templates, with shortened spacer sequences (8 bp spacer sequences), were designed, which allowed for increased donor template sequence length (by 10 bp, see V4.1 and V4.2), or for the inclusion of an additional Tet Operator sequence attached to the donor template sequence (V5.1 and V5.2), as shown in Table 9 and FIG. 9.

Based on these findings, Cas9 fusion molecules comprising a Cas9 molecule, e.g., wild type Cas9 molecule, linked to a Tet Repressor molecule, may be generated using established molecular biology techniques. In addition, a nucleic acid template system comprising a template binding domain partner comprising, e.g., three Tet Operator sequences, organized in one or more configurations described above, and a template nucleic acid, may also be generated. U2OS cells may be electroporated with 200 ng of gRNA targeting the HBB endogenous locus (gRNA #8 (GTAACGGCAGACTTCTCCTC)(SEQ ID NO: 168) and gRNA #15 (AAGGTGAACGTGGATGAAGT) (SEQ ID NO: 169)), 750 ng of plasmid encoding a Cas9 fusion molecule, comprising, e.g., a wild type Cas9 or mutant Cas9 (D10A or N863A) fused to wild type Tet Repressor molecule, or to a mutant Tet Repressor molecule as a negative control. Simultaneously, the cells may also be electroporated with 25 pmol of the aforementioned optimized single stranded oligo (SSODN). Cells are collected 6 days after electroporation and genomic DNA extracted. PCR amplification of the HBB locus is performed and amplicons are subcloned into Topo Blunt Vector. For each condition, 96 colonies are sequenced using Sanger sequencing and homology-directed repair efficacy is assessed.

Unless otherwise defined, all technical and scientific terms used herein have the same meaning as commonly understood by one of ordinary skill in the art to which this invention belongs. Although methods and materials similar or equivalent to those described herein can be used in the practice or testing of the present invention, suitable methods and materials are described below. In addition, the materials, methods, and examples are illustrative only and not intended to be limiting.

Headings, including numeric and alphabetical headings and subheadings, are for organization and presentation and are not intended to be limiting.

INCORPORATION BY REFERENCE

All publications, patents, and patent applications mentioned herein are hereby incorporated by reference in their entirety as if each individual publication, patent, or patent application was specifically and individually indicated to be incorporated by reference. In case of conflict, the present application, including any definitions herein, will control.

EQUIVALENTS

Those skilled in the art will recognize, or be able to ascertain using no more than routine experimentation, many equivalents to the specific embodiments of the invention described herein. Such equivalents are intended to be encompassed by the following claims.

TABLE 9

| Template ID | Description | SEQ ID NO | Sequence |
| --- | --- | --- | --- |
| V4.1 | 3xTetO (8bp spacer)-ssODN-119 | 170 | TCCCTATCAGTGATAGAGAACGTATGTTCCC TATCAGTGATAGAGAACGTATGTTCCCTATC AGTGATAGAGAACGTATGTCCTCAAACAGA CACCATGGTGCATCTGACTCGTGTGGAGAAG TCGGCCGTTACTGCCCTGCAGGGCAAGCTTA ACGTGGATGAAGTTCGTGGTGAGGCCCTGG GCAGGTTGGTATCAAG |
| V4.2 | ssODN-119-3xTetO (8bp spacer) | 171 | CCTCAAACAGACACCATGGTGCATCTGACTC GTGTGGAGAAGTCGGCCGTTACTGCCCTGCA GGGCAAGCTTAACGTGGATGAAGTTCGTGG TGAGGCCCTGGGCAGGTTGGTATCAAGTCCC TATCAGTGATAGAGAACGTATGTTCCCTATC AGTGATAGAGAACGTATGTTCCCTATCAGTG ATAGAGAACGTATGT |
| V5.1 | (4xTetO (8bp spacer)-ssODN-100 | 172 | TCCCTATCAGTGATAGAGAACGTATGTTCCC TATCAGTGATAGAGAACGTATGTTCCCTATC AGTGATAGAGAACGTATGTTCCCTATCAGTG ATAGAGAACACCATGGTGCATCTGACTCGTG TGGAGAAGTCGGCCGTTACTGCCCTGCAGG GCAAGCTTAACGTGGATGAAGTTCGTGGTG AGGCCCTGGGCAGGT |
| V5.2 | ssODN-100-4xTetO (8bp spacer) | 173 | ACACCATGGTGCATCTGACTCGTGTGGAGAA GTCGGCCGTTACTGCCCTGCAGGGCAAGCTT AACGTGGATGAAGTTCGTGGTGAGGCCCTG GGCAGGTTCCCTATCAGTGATAGAGAACGT ATGTTCCCTATCAGTGATAGAGAACGTATGT TCCCTATCAGTGATAGAGAACGTATGTTCCC TATCAGTGATAGAGA |

Other embodiments are within the following claims.

SEQUENCE LISTING (173 sequences)

SEQ ID NO: 1 - protein, 30 aa, Artificial Sequence
  Synthetic
  misc_feature (4)..(30): "GGS" may or may not be present
GGSGGSGGSGGSGGSGGSGGSGGSGGSGGS

SEQ ID NO: 2 - protein, 16 aa, Artificial Sequence
  Synthetic
SGSETPGTSESATPES

SEQ ID NO: 3 - protein, 48 aa, Artificial Sequence
  Synthetic
  misc_feature (13)..(48): "GSAGSAAGSGEF" may or may not be present
GSAGSAAGSGEFGSAGSAAGSGEFGSAGSAAGSGEFGSAGSAAGSGEF

SEQ ID NO: 4 - protein, 48 aa, Artificial Sequence
  Synthetic
  misc_feature (13)..(48): "SIVAQLSRPDPA" may or may not be present
SIVAQLSRPDPASIVAQLSRPDPASIVAQLSRPDPASIVAQLSRPDPA

SEQ ID NO: 5 - RNA, 96 nt, Artificial Sequence
  Synthetic
  misc_feature (1)..(20): n is a, c, g, or u
nnnnnnnnnnnnnnnnnnnnguuuuagagcuagaaauagcaaguuaaaauaaggcuaguccguuaucaacuugaaaaaguggcaccgagucggugc

SEQ ID NO: 6 - protein, 1053 aa, Staphylococcus aureus
MKRNYILGLDIGITSVGYGIIDYETRDVIDAGVRLFKEANVENNEGRRSKRGARRLKRRRRHRIQRVKKLLFDYNLLTDHSELSGINPYEARVKGLSQKLSEEEFSAALLHLAKRRGVHNVNEVEEDTGNELSTKEQISRNSKALEEKYVAELQLERLKKDGEVRGSINRFKTSDYVKEAKQLLKVQKAYHQLDQSFIDTYIDLLETRRTYYEGPGEGSPFGWKDIKEWYEMLMGHCTYFPEELRSVKYAYNADLYNALNDLNNLVITRDENEKLEYYEKFQIIENVFKQKKKPTLKQIAKEILVNEEDIKGYRVTSTGKPEFTNLKVYHDIKDITARKEIIENAELLDQIAKILTIYQSSEDIQEELTNLNSELTQEEIEQISNLKGYTGTHNLSLKAINLILDELWHTNDNQIAIFNRLKLVPKKVDLSQQKEIPTTLVDDFILSPVVKRSFIQSIKVINAIIKKYGLPNDIIIELAREKNSKDAQKMINEMQKRNRQTNERIEEIIRTTGKENAKYLIEKIKLHDMQEGKCLYSLEAIPLEDLLNNPFNYEVDHIIPRSVSFDNSFNNKVLVKQEENSKKGNRTPFQYLSSSDSKISYETFKKHILNLAKGKGRISKTKKEYLLEERDINRFSVQKDFINRNLVDTRYATRGLMNLLRSYFRVNNLDVKVKSINGGFTSFLRRKWKFKKERNKGYKHHAEDALIIANADFIFKEWKKLDKAKKVMENQMFEEKQAESMPEIETEQEYKEIFITPHQIKHIKDFKDYKYSHRVDKKPNRELINDTLYSTRKDDKGNTLIVNNLNGLYDKDNDKLKKLINKSPEKLLMYHHDPQTYQKLKLIMEQYGDEKNPLYKYYEETGNYLTKYSKKDNGPVIKKIKYYGNKLNAHLDITDDYPNSRNKVVKLSLKPYRFDVYLDNGVYKFVTVKNLDVIKKENYYEVNSKCYEEAKKLKKISNQAEFIASFYNNDLIKINGELYRVIGVNNDLLNRIEVNMIDITYREYLENMNDKRPPRIIKTIASKTQSIKKYSTDILGNLYEVKSKKHPQIIKKG

SEQ ID NO: 7 - protein, 1368 aa, Streptococcus pyogenes [sequence omitted]

SEQ ID NO: 8 - protein, 984 aa, Campylobacter jejuni NCTC 11168
MARILAFDIGISSIGWAFSENDELKDCGVRIFTKVENPKTGESLALPRRLARSARKRLARRKARLNHLKHLIANEFKLNYEDYQSFDESLAKAYKGSLISPYELRFRALNELLSKQDFARVILHIAKRRGYDDIKNSDDKEKGAILKAIKQNEEKLANYQSVGEYLYKEYFQKFKENSKEFTNVRNKKESYERCIAQSFLKDELKLIFKKQREFGFSFSKKFEEEVLSVAFYKRALKDFSHLVGNCSFFTDEKRAPKNSPLAFMFVALTRIINLLNNLKNTEGILYTKDDLNALLNEVLKNGTLTYKQTKKLLGLSDDYEFKGEKGTYFIEFKKYKEFIKALGEHNLSQDDLNEIAKDITLIKDEIKLKKALAKYDLNQNQIDSLSKLEFKDHLNISFKALKLVTPLMLEGKKYDEACNELNLKVAINEDKKDFLPAFNETYYKDEVTNPVVLRAIKEYRKVLNALLKKYGKVHKINIELAREVGKNHSQRAKIEKEQNENYKAKKDAELECEKLGLKINSKNILKLRLFKEQKEFCAYSGEKIKISDLQDEKMLEIDHIYPYSRSFDDSYMNKVLVFTKQNQEKLNQTPFEAFGNDSAKWQKIEVLAKNLPTKKQKRILDKNYKDKEQKNFKDRNLNDTRYIARLVLNYTKDYLDFLPLSDDENTKLNDTQKGSKVHVEAKSGMLTSALRHTWGFSAKDRNNHLHHAIDAVIIAYANNSIVKAFSDFKKEQESNSAELYAKKISELDYKNKRKFFEPFSGFRQKVLDKIDEIFVSKPERKKPSGALHEETFRKEEEFYQSYGGKEGVLKALELGKIRKVNGKIVKNGDMFRVDIFKHKKTNKFYAVPIYTMDFALKVLPNKAVARSKKGEIKDWILMDENYEFCFSLYKDSLILIQTKDMQEPEFVYYNAFTSSTVSLIVSKHDNKFETLSKNQKILFKNANEKEVIAKSIGIQNLKVFEKYIVSALGEVTKAEFRQREDFKK

SEQ ID NO: 9 - protein, 1436 aa, Bacteroides fragilis NCTC 9343
MKRILGLDLGTNSIGWALVNEAENKDERSSIVKLGVRVNPLTVDELTNFEKGKSITTNADRTLKRGMRRNLQRYKLRRETLTEVLKEHKLITEDTILSENGNRTTFETYRLRAKAVTEEISLEEFARVLLMINKKRGYKSSRKAKGVEEGTLIDGMDIARELYNNNLTPGELCLQLLDAGKKFLPDFYRSDLQNELDRIWEKQKEYYPEILTDVLKEELRGKKRDAVWAICAKYFVWKENYTEWNKEKGKTEQQEREHKLEGIYSKRKRDEAKRENLQWRVNGLKEKLSLEQLVIVFQEMNTQINNSSGYLGAISDRSKELYFNKQTVGQYQMEMLDKNPNASLRNMVFYRQDYLDEFNMLWEKQAVYHKELTEELKKEIRDIIIFYQRRLKSQKGLIGFCEFESRQIEVDIDGKKKIKTVGNRVISRSSPLFQEFKIWQILNNIEVTVVGKKRKRRKLKENYSALFEELNDAEQLELNGSRRLCQEEKELLAQELFIRDKMTKSEVLKLLFDNPQELDLNFKTIDGNKTGYALFQAYSKMIEMSGHEPVDFKKPVEKVVEYIKAVFDLLNWNTDILGFNSNEELDNQPYYKLWHLLYSFEGDNTPTGNGRLIQKMTELYGFEKEYATILANVSFQDDYGSLSAKAIHKILPHLKEGNRYDVACVYAGYRHSESSLTREEIANKVLKDRLMLLPKNSLHNPVVEKILNQMVNVINVIIDIYGKPDEIRVELARELKKNAKEREELTKSIAQTTKAHEEYKTLLQTEFGLTNVSRTDILRYKLYKELESCGYKTLYSNTYISREKLFSKEFDIEHIIPQARLFDDSFSNKTLEARSVNIEKGNKTAYDFVKEKFGESGADNSLEHYLNNIEDLFKSGKISKTKYNKLKMAEQDIPDGFIERDLRNTQYIAKKALSMLNEISHRVVATSGSVTDKLREDWQLIDVMKELNWEKYKALGLVEYFEDRDGRQIGRIKDWTKRNDHRHHAMDALTVAFTKDVFIQYFNNKNASLDPNANEHAIKNKYFQNGRAIAPMPLREFRAEAKKHLENTLISIKAKNKVITGNINKTRKKGGVNKNMQQTPRGQLHLETIYGSGKQYLTKEEKVNASFDMRKIGTVSKSAYRDALLKRLYENDNDPKKAFAGKNSLDKQPIWLDKEQMRKVPEKVKIVTLEAIYTIRKEISPDLKVDKVIDVGVRKILIDRLNEYGNDAKKAFSNLDKNPIWLNKEKGISIKRVTISGISNAQSLHVKKDKDGKPILDENGRNIPVDFVNTGNNHHVAVYYRPVIDKRGQLVVDEAGNPKYELEEVVVSFFEAVTRANLGLPIIDKDYKTTEGWQFLFSMKQNEYFVFPNEKTGFNPKEIDLLDVENYGLISPNLFRVQKFSLKNYVFRHHLETTIKDTSSILRGITWIDFRSSKGLDTIVKVRVNHIGQIVSVGEY

SEQ ID NO: 10 - protein, 1420 aa, Bifidobacterium bifidum S17
MSRKNYVDDYAISLDIGNASVGWSAFTPNYRLVRAKGHELIGVRLFDPADTAESRRMARTTRRRYSRRRWRLRLLDALFDQALSEIDPSFLARRKYSWVHPDDENNADCWYGSVLFDSNEQDKRFYEKYPTIYHLRKALMEDDSQHDIREIYLAIHHMVKYRGNFLVEGTLESSNAFKEDELLKLLGRITRYEMSEGEQNSDIEQDDENKLVAPANGQLADALCATRGSRSMRVDNALEALSAVNDLSREQRAIVKAIFAGLEGNKLDLAKIFVSKEFSSENKKILGIYFNKSDYEEKCVQIVDSGLLDDEEREFLDRMQGQYNAIALKQLLGRSTSVSDSKCASYDAHRANWNLIKLQLRTKENEKDINENYGILVGWKIDSGQRKSVRGESAYENMRKKANVFFKKMIETSDLSETDKNRLIHDIEEDKLFPIQRDSDNGVIPHQLHQNELKQIIKKQGKYYPFLLDAFEKDGKQINKIEGLLTFRVPYFVGPLVVPEDLQKSDNSENHWMVRKKKGEITPWNFDEMVDKDASGRKFIERLVGTDSYLLGEPTLPKNSLLYQEYEVLNELNNVRLSVRTGNHWNDKRRMRLGREEKTLLCQRLFMKGQTVTKRTAENLLRKEYGRTYELSGLSDESKFTSSLSTYGKMCRIFGEKYVNEHRDLMEKIVELQTVFEDKETLLHQLRQLEGISEADCALLVNTHYTGWGRLSRKLLTTKAGECKISDDFAPRKHSIIEIMRAEDRNLMEIITDKQLGFSDWIEQENLGAENGSSLMEVVDDLRVSPKVKRGIIQSIRLIDDISKAVGKRPSRIFLELADDIQPSGRTISRKSRLQDLYRNANLGKEFKGIADELNACSDKDLQDDRLFLYYTQLGKDMYTGEELDLDRLSSAYDIDHIIPQAVTQNDSIDNRVLVARAENARKTDSFTYMPQIADRMRNFWQILLDNGLISRVKFERLTRQNEFSEREKERFVQRSLVETRQIMKNVATLMRQRYGNSAAVIGLNAELTKEMHRYLGFSHKNRDINDYHHAQDALCVGIAGQFAANRGFFADGEVSDGAQNSYNQYLRDYLRGYREKLSAEDRKQGRAFGFIVGSMRSQDEQKRVNPRTGEVVWSEEDKDYLRKVMNYRKMLVTQKVGDDFGALYDETRYAATDPKGIKGIPFDGAKQDTSLYGGFSSAKPAYAVLIESKGKTRLVNVTMQEYSLLGDRPSDDELRKVLAKKKSEYAKANILLRHVPKMQLIRYGGGLMVIKSAGELNNAQQLWLPYEEYCYFDDLSQGKGSLEKDDLKKLLDSILGSVQCLYPWHRFTEEELADLHVAFDKLPEDEKKNVITGIVSALHADAKTANLSIVGMTGSWRRMNNKSGYTFSDEDEFIFQSPSGLFEKRVTVGELKRKAKKEVNSKYRTNEKRLPTLSGASQP

SEQ ID NO: 11 - protein, 1397 aa, Veillonella atypica ACS-134-V-Col7a
METQTSNQLITSHLKDYPKQDYFVGLDIGTNSVGWAVTNTSYELLKFHSHKMWGSRLFEEGESAVTRRGFRSMRRRLERRKLRLKLLEELFADAMAQVDSTFFIRLHESKYHYEDKTTGHSSKHILFIDEDYTDQDYFTEYPTIYHLRKDLMENGTDDIRKLFLAVHHILKYRGNFLYEGATFNSNAFTFEDVLKQALVNITFNCFDTNSAISSISNILMESGKTKSDKAKAIERLVDTYTVFDEVNTPDKPQKEQVKEDKKTLKAFANLVLGLSANLIDLFGSVEDIDDDLKKLQIVGDTYDEKRDELAKVWGDEIHIIDDCKSVYDAIILMSIKEPGLTISQSKVKAFDKHKEDLVILKSLLKLDRNVYNEMFKSDKKGLHNYVHYIKQGRTEETSCSREDFYKYTKKIVEGLADSKDKEYILNEIELQTLLPLQRIKDNGVIPYQLHLEELKVILDKCGPKFPFLHTVSDGFSVTEKLIKMLEFRIPYYVGPLNTHHNIDNGGFSWAVRKQAGRVTPWNFEEKIDREKSAAAFIKNLTNKCTYLFGEDVLPKSSLLYSEFMLLNELNNVRIDGKALAQGVKQHLIDSIFKQDHKKMTKNRIELFLKDNNYITKKHKPEITGLDGEIKNDLTSYRDMVRILGNNFDVSMAEDIITDITIFGESKKMLRQTLRNKFGSQLNDETIKKLSKLRYRDWGRLSKKLLKGIDGCDKAGNGAPKTIIELMRNDSYNLMEILGDKFSFMECIEEENAKLAQGQVVNPHDIIDELALSPAVKRAVWQALRIVDEVAHIKKALPSRIFVEVARTNKSEKKKKDSRQKRLSDLYSAIKKDDVLQSGLQDKEFGALKSGLANYDDAALRSKKLYLYYTQMGRCAYTGNIIDLNQLNTDNYDIDHIYPRSLTKDDSFDNLVLCERTANAKKSDIYPIDNRIQTKQKPFWAFLKHQGLISERKYERLTRIAPLTADDLSGFIARQLVETNQSVKATTTLLRRLYPDIDVVFVKAENVSDFRHNNNFIKVRSLNHHHHAKDAYLNIVVGNVYHEKFTRNFRLFFKKNGANRTYNLAKMFNYDVICTNAQDGKAWDVKTSMNTVKKMMASNDVRVTRRLLEQSGALADATIYKASVAAKAKDGAYIGMKTKYSVFADVTKYGGMTKIKNAYSIIVQYTGKKGEEIKEIVPLPIYLINRNATDIELIDYVKSVIPKAKDISIKYRKLCINQLVKVNGFYYYLGGKTNDKIYIDNAIELVVPHDIATYIKLLDKYDLLRKENKTLKASSITTSIYNINTSTVVSLNKVGIDVFDYFMSKLRTPLYMKMKGNKVDELSSTGRSKFIKMTLEEQSIYLLEVLNLLTNSKTTFDVKPLGITGSRSTIGVKIHNLDEFKIINESITGLYSNEVTIV

SEQ ID NO: 12 - protein, 1363 aa, Lactobacillus rhamnosus GG
MTKLNQPYGIGLDIGSNSIGFAVVDANSHLLRLKGETAIGARLFREGQSAADRRGSRTTRRRLSRTRWRLSFLRDFFAPHITKIDPDFFLRQKYSEISPKDKDRFKYEKRLFNDRTDAEFYEDYPSMYHLRLHLMTHTHKADPREIFLAIHHILKSRGHFLTPGAAKDFNTDKVDLEDIFPALTEAYAQVYPDLELTFDLAKADDFKAKLLDEQATPSDTQKALVNLLLSSDGEKEIVKKRKQVLTEFAKAITGLKTKFNLALGTEVDEADASNWQFSMGQLDDKWSNIETSMTDQGTEIFEQIQELYRARLLNGIVPAGMSLSQAKVADYGQHKEDLELFKTYLKKLNDHELAKTIRGLYDRYINGDDAKPFLREDFVKALTKEVTAHPNEVSEQLLNRMGQANFMLKQRTKANGAIPIQLQQRELDQIIANQSKYYDWLAAPNPVEAHRWKMPYQLDELLNFHIPYYVGPLITPKQQAESGENVFAWMVRKDPSGNITPYNFDEKVDREASANTFIQRMKTTDTYLIGEDVLPKQSLLYQKYEVLNELNNVRINNECLGTDQKQRLIREVFERHSSVTIKQVADNLVAHGDFARRPEIRGLADEKRFLSSLSTYHQLKEILHEAIDDPTKLLDIENIITWSTVFEDHTIFETKLAEIEWLDPKKINELSGIRYRGWGQFSRKLLDGLKLGNGHTVIQELMLSNHNLMQILADETLKETMTELNQDKLKTDDIEDVINDAYTSPSNKKALRQVLRVVEDIKHAANGQDPSWLFIETADGTGTAGKRTQSRQKQIQTVYANAAQELIDSAVRGELEDKIADKASFTDRLVLYFMQGGRDIYTGAPLNIDQLSHYDIDHILPQSLIKDDSLDNRVLVNATINREKNNVFASTLFAGKMKATWRKWHEAGLISGRKLRNLMLRPDEIDKFAKGFVARQLVETRQIIKLTEQIAAAQYPNTKIIAVKAGLSHQLREELDFPKNRDVNHYHHAFDAFLAARIGTYLLKRYPKLAPFFTYGEFAKVDVKKFREFNFIGALTHAKKNIIAKDTGEIVWDKERDIRELDRIYNFKRMLITHEVYFETADLFKQTIYAAKDSKERGGSKQLIPKKQGYPTQVYGGYTQESGSYNALVRVAEADTTAYQVIKISAQNASKIASANLKSREKGKQLLNEIVVKQLAKRRKNWKPSANSFKIVIPRFGMGTLFQNAKYGLFMVNSDTYYRNYQELWLSRENQKLLKKLFSIKYEKTQMNHDALQVYKAIIDQVEKFFKLYDINQFRAKLSDAIERFEKLPINTDGNKIGKTETLRQILIGLQANGTRSNVKNLGIKTDLGLLQVGSGIKLDKDTQIVYQSPSGLFKRRIPLADL

SEQ ID NO: 13 - protein, 1365 aa, Filifactor alocis ATCC 35896
MTKEYYLGLDVGTNSVGWAVTDSQYNLCKFKKKDMWGIRLFESANTAKDRRLQRGNRRRLERKKQRIDLLQEIFSPEICKIDPTFFIRLNESRLHLEDKSNDFKYPLFIEKDYSDIEYYKEFPTIFHLRKHLIESEEKQDIRLIYLALHNIIKTRGHFLIDGDLQSAKQLRPILDTFLLSLQEEQNLSVSLSENQKDEYEEILKNRSIAKSEKVKKLKNLFEISDELEKEEKKAQSAVIENFCKFIVGNKGDVCKFLRVSKEELEIDSFSFSEGKYEDDIVKNLEEKVPEKVYLFEQMKAMYDWNILVDILETEEYISFAKVKQYEKHKTNLRLLRDIILKYCTKDEYNRMFNDEKEAGSYTAYVGKLKKNNKKYWIEKKRNPEEFYKSLGKLLDKIEPLKEDLEVLTMMIEECKNHTLLPIQKNKDNGVIPHQVHEVELKKILENAKKYYSFLTETDKDGYSVVQKIESIFRFRIPYYVGPLSTRHQEKGSNVWMVRKPGREDRIYPWNMEEIIDFEKSNENFITRMTNKCTYLIGEDVLPKHSLLYSKYMVLNELNNVKVRGKKLPTSLKQKVFEDLFENKSKVTGKNLLEYLQIQDKDIQIDDLSGFDKDFKTSLKSYLDFKKQIFGEEIEKESIQNMIEDIIKWITIYGNDKEMLKRVIRANYSNQLTEEQMKKITGFQYSGWGNFSKMFLKGISGSDVSTGETFDIITAMWETDNNLMQILSKKFTFMDNVEDFNSGKVGKIDKITYDSTVKEMFLSPENKRAVWQTIQVAEEIKKVMGCEPKKIFIEMARGGEKVKKRTKSRKAQLLELYAACEEDCRELIKEIEDRDERDFNSMKLFLYYTQFGKCMYSGDDIDINELIRGNSKWDRDHIYPQSKIKDDSIDNLVLVNKTYNAKKSNELLSEDIQKKMHSFWLSLLNKKLITKSKYDRLTRKGDFTDEELSGFIARQLVETRQSTKAIADIFKQIYSSEVVYVKSSLVSDFRKKPLNYLKSRRVNDYHHAKDAYLNIVVGNVYNKKFTSNPIQWMKKNRDTNYSLNKVFEHDVVINGEVIWEKCTYHEDTNTYDGGTLDRIRKIVERDNILYTEYAYCEKGELFNATIQNKNGNSTVSLKKGLDVKKYGGYFSANTSYFSLIEFEDKKGDRARHIIGVPIYIANMLEHSPSAFLEYCEQKGYQNVRILVEKIKKNSLLIINGYPLRIRGENEVDTSFKRAIQLKLDQKNYELVRNIEKFLEKYVEKKGNYPIDENRDHITHEKMNQLYEVLLSKMKKFNKKGMADPSDRIEKSKPKFIKLEDLIDKINVINKMLNLLRCDNDTKADLSLIELPKNAGSFVVKKNTIGKSKIILVNQSVTGLYENRREL

SEQ ID NO: 14 - protein, 1389 aa, Oenococcus kitaharae DSM 17330
MARDYSVGLDIGTSSVGWAAIDNKYHLIRAKSKNLIGVRLFDSAVTAEKRRGYRTTRRRLSRRHWRLRLLNDIFAGPLTDFGDENFLARLKYSWVHPQDQSNQAHFAAGLLFDSKEQDKDFYRKYPTIYHLRLALMNDDQKHDLREVYLAIHHLVKYRGHFLIEGDVKADSAFDVHTFADAIQRYAESNNSDENLLGKIDEKKLSAALTDKHGSKSQRAETAETAFDILDLQSKKQIQAILKSVVGNQANLMAIFGLDSSAISKDEQKNYKFSFDDADIDEKIADSEALLSDTEFEFLCDLKAAFDGLTLKMLLGDDKTVSAAMVRRFNEHQKDWEYIKSHIRNAKNAGNGLYEKSKKFDGINAAYLALQSDNEDDRKKAKKIFQDEISSADIPDDVKADFLKKIDDDQFLPIQRTKNNGTIPHQLHRNELEQIIEKQGIYYPFLKDTYQENSHELNKITALINFRVPYYVGPLVEEEQKIADDGKNIPDPTNHWMVRKSNDTITPWNLSQVVDLDKSGRRFIERLTGTDTYLIGEPTLPKNSLLYQKFDVLQELNNIRVSGRRLDIRAKQDAFEHLFKVQKTVSATNLKDFLVQAGYISEDTQIEGLADVNGKNFNNALTTYNYLVSVLGREFVENPSNEELLEEITELQTVFEDKKVLRRQLDQLDGLSDHNREKLSRKHYTGWGRISKKLLTTKIVQNADKIDNQTFDVPRMNQSIIDTLYNTKMNLMEIINNAEDDFGVRAWIDKQNTTDGDEQDVYSLIDELAGPKEIKRGIVQSFRILDDITKAVGYAPKRVYLEFARKTQESHLTNSRKNQLSTLLKNAGLSELVTQVSQYDAAALQNDRLYLYFLQQGKDMYSGEKLNLDNLSNYDIDHIIPQAYTKDNSLDNRVLVSNITNRRKSDSSNYLPALIDKMRPFWSVLSKQGLLSKHKFANLTRTRDFDDMEKERFIARSLVETRQIIKNVASLIDSHFGGETKAVAIRSSLTADMRRYVDIPKNRDINDYHHAFDALLFSTVGQYTENSGLMKKGQLSDSAGNQYNRYIKEWIHAARLNAQSQRVNPFGFVVGSMRNAAPGKLNPETGEITPEENADWSIADLDYLHKVMNFRKITVTRRLKDQKGQLYDESRYPSVLHDAKSKASINFDKHKPVDLYGGFSSAKPAYAALIKFKNKFRLVNVLRQWTYSDKNSEDYILEQIRGKYPKAEMVLSHIPYGQLVKKDGALVTISSATELHNFEQLWLPLADYKLINTLLKTKEDNLVDILHNRLDLPEMTIESAFYKAFDSILSFAFNRYALHQNALVKLQAHRDDFNALNYEDKQQTLERILDALHASPASSDLKKINLSSGFGRLFSPSHFTLADTDEFIFQSVTGLFSTQKTVAQLYQETK

SEQ ID NO: 15 - protein, 1323 aa, Fructobacillus fructosus KCTC 3544
MVYDVGLDIGTGSVGWVALDENGKLARAKGKNLVGVRLFDTAQTAADRRGFRTTRRRLSRRKWRLRLLDELFSAEINEIDSSFFQRLKYSYVHPKDEENKAHYYGGYLFPTEEETKKFHRSYPTIYHLRQELMAQPNKRFDIREIYLAIHHLVKYRGHFLSSQEKITIGSTYNPEDLANAIEVYADEKGLSWELNNPEQLTEIISGEAGYGLNKSMKADEALKLFEFDNNQDKVAIKTLLAGLTGNQIDFAKLFGKDISDKDEAKLWKLKLDDEALEEKSQTILSQLTDEEIELFHAVVQAYDGFVLIGLLNGADSVSAAMVQLYDQHREDRKLLKSLAQKAGLKHKRFSEIYEQLALATDEATIKNGISTARELVEESNLSKEVKEDTLRRLDENEFLPKQRTKANSVIPHQLHLAELQKILQNQGQYYPFLLDTFEKEDGQDNKIEELLRFRIPYYVGPLVTKKDVEHAGGDADNHWVERNEGFEKSRVTPWNFDKVFNRDKAARDFIERLTGNDTYLIGEKTLPQNSLRYQLFTVLNELNNVRVNGKKFDSKTKADLINDLFKARKTVSLSALKDYLKAQGKGDVTITGLADESKFNSSLSSYNDLKKTFDAEYLENEDNQETLEKIIEIQTVFEDSKIASRELSKLPLDDDQVKKLSQTHYTGWGRLSEKLLDSKIIDERGQKVSILDKLKSTSQNFMSIINNDKYGVQAWITEQNTGSSKLTFDEKVNELTTSPANKRGIKQSFAVLNDIKKAMKEEPRRVYLEFAREDQTSVRSVPRYNQLKEKYQSKSLSEEAKVLKKTLDGNKNKMSDDRYFLYFQQQGKDMYTGRPINFERLSQDYDIDHIIPQAFTKDDSLDNRVLVSRPENARKSDSFAYTDEVQKQDGSLWTSLLKSGFINRKKYERLTKAGKYLDGQKTGFIARQLVETRQIIKNVASLIEGEYENSKAVAIRSEITADMRLLVGIKKHREINSFHHAFDALLITAAGQYMQNRYPDRDSTNVYNEFDRYTNDYLKNLRQLSSRDEVRRLKSFGFVVGTMRKGNEDWSEENTSYLRKVMMFKNILTTKKTEKDRGPLNKETIFSPKSGKKLIPLNSKRSDTALYGGYSNVYSAYMTLVRANGKNLLIKIPISIANQIEVGNLKINDYIVNNPAIKKFEKILISKLPLGQLVNEDGNLIYLASNEYRHNAKQLWLSTTDADKIASISENSSDEELLEAYDILTSENVKNRFPFFKKDIDKLSQVRDEFLDSDKRIAVIQTILRGLQIDAAYQAPVKIISKKVSDWHKLQQSGGIKLSDNSEMIYQSATGIFETRVKISDLL

SEQ ID NO: 16 - protein, 1329 aa, Catenibacterium mitsuokai DSM 15897
IVDYCIGLDLGTGSVGWAVVDMNHRLMKRNGKHLWGSRLFSNAETAANRRASRSIRRRYNKRRERIRLLRAILQDMVLEKDPTFFIRLEHTSFLDEEDKAKYLGTDYKDNYNLFIDEDFNDYTYYHKYPTIYHLRKALCESTEKADPRLIYLALHHIVKYRGNFLYEGQKFNMDASNIEDKLSDIFTQFTSFNNIPYEDDEKKNLEILEILKKPLSKKAKVDEVMTLIAPEKDYKSAFKELVTGIAGNKMNVTKMILCEPIKQGDSEIKLKFSDSNYDDQFSEVEKDLGEYVEFVDALHNVYSWVELQTIMGATHTDNASISEAMVSRYNKHHDDLKLLKDCIKNNVPNKYFDMFRNDSEKSKGYYNYINRPSKAPVDEFYKYVKKCIEKVDTPEAKQILNDIELENFLLKQNSRTNGSVPYQMQLDEMIKIIDNQAEYYPILKEKREQLLSILTFRIPYYFGPLNETSEHAWIKRLEGKENQRILPWNYQDIVDVDATAEGFIKRMRSYCTYFPDEEVLPKNSLIVSKYEVYNELNKIRVDDKLLEVDVKNDIYNELFMKNKTVTEKKLKNWLVNNQCCSKDAEIKGFQKENQFSTSLTPWIDFTNIFGKIDQSNFDLIENIIYDLTVFEDKKIMKRRLKKKYALPDDKVKQILKLKYKDWSRLSKKLLDGIVADNRFGSSVTVLDVLEMSRLNLMEIINDKDLGYAQMIEEATSCPEDGKFTYEEVERLAGSPALKRGIWQSLQIVEEITKVMKCRPKYIYIEFERSEEAKERTESKIKKLENVYKDLDEQTKKEYKSVLEELKGFDNTKKISSDSLFLYFTQLGKCMYSGKKLDIDSLDKYQIDHIVPQSLVKDDSFDNRVLVVPSENQRKLDDLVVPFDIRDKMYRFWKLLFDHELISPKKFYSLIKTEYTERDEERFINRQLVETRQITKNVTQIIEDHYSTTKVAAIRANLSHEFRVKNHIYKNRDINDYHHAHDAYIVALIGGFMRDRYPNMHDSKAVYSEYMKMFRKNKNDQKRWKDGFVINSMNYPYEVDGKLIWNPDLINEIKKCFYYKDCYCTTKLDQKSGQLFNLTVLSNDAHADKGVTKAVVPVNKNRSDVHKYGGFSGLQYTIVAIEGQKKKGKKTELVKKISGVPLHLKAASINEKINYIEEKEGLSDVRIIKDNIPVNQMIEMDGGEYLLTSPTEYVNARQLVLNEKQCALIADIYNAIYKQDYDNLDDILMIQLYIELTNKMKVLYPAYRGIAEKFESMNENYVVISKEEKANIIKQMLIVMHRGPQNGNIVYDDFKISDRIGRLKTKNHNLNNIVFISQSPTGIYTKKYKL

SEQ ID NO: 17 - protein, 1348 aa, Finegoldia magna ATCC 29328
MKSEKKYYIGLDVGTNSVGWAVTDEFYNILRAKGKDLWGVRLFEKADTAANTRIFRSGRRRNDRKGMRLQILREIFEDEIKKVDKDFYDRLDESKFWAEDKKVSGKYSLFNDKNFSDKQYFEKFPTIFHLRKYLMEEHGKVDIRYYFLAINQMMKRRGHFLIDGQISHVTDDKPLKEQLILLINDLLKIELEEELMDSIFEILADVNEKRTDKKNNLKELIKGQDFNKQEGNILNSIFESIVTGKAKIKNIISDEDILEKIKEDNKEDFVLTGDSYEENLQYFEEVLQENITLFNTLKSTYDFLILQSILKGKSTLSDAQVERYDEHKKDLEILKKVIKKYDEDGKLFKQVFKEDNGNGYVSYIGYYLNKNKKITAKKKISNIEFTKYVKGILEKQCDCEDEDVKYLLGKIEQENFLLKQISSINSVIPHQIHLFELDKILENLAKNYPSFNNKKEEFTKIEKIRKTFTFRIPYYVGPLNDYHKNNGGNAWIFRNKGEKIRPWNFEKIVDLHKSEEEFIKRMLNQCTYLPEETVLPKSSILYSEYMVLNELNNLRINGKPLDTDVKLKLIEELFKKKTKVTLKSIRDYMVRNNFADKEDFDNSEKNLEIASNMKSYIDFNNILEDKFDVEMVEDLIEKITIHTGNKKLLKKYIEETYPDLSSSQIQKIINLKYKDWGRLSRKLLDGIKGTKKETEKTDTVINFLRNSSDNLMQIIGSQNYSFNEYIDKLRKKYIPQEISYEVVENLYVSPSVKKMIWQVIRVTEEITKVMGYDPDKIFIEMAKSEEEKKTTISRKNKLLDLYKAIKKDERDSQYEKLLTGLNKLDDSDLRSRKLYLYYTQMGRDMYTGEKIDLDKLFDSTHYDKDHIIPQSMKKDDSIINNLVLVNKNANQTTKGNIYPVPSSIRNNPKIYNYWKYLMEKEFISKEKYNRLIRNTPLTNEELGGFINRQLVETRQSTKAIKELFEKFYQKSKIIPVKASLASDLRKDMNTLKSREVNDLHHAHDAFLNIVAGDVWNREFTSNPINYVKENREGDKVKYSLSKDFTRPRKSKGKVIWTPEKGRKLIVDTLNKPSVLISNESHVKKGELFNATIAGKKDYKKGKIYLPLKKDDRLQDVSKYGGYKAINGAFFFLVEHTKSKKRIRSIELFPLHLLSKFYEDKNTVLDYAINVLQLQDPKIIIDKINYRTEIIIDNFSYLISTKSNDGSITVKPNEQMYWRVDEISNLKKIENKYKKDAILTEEDRKIMESYIDKIYQQFKAGKYKNRRTTDTIIEKYEIIDLDTLDNKQLYQLLVAFISLSYKTSNNAVDFTVIGLGTECGKPRITNLPDNTYLVYKSITGIYEKRIRIK

SEQ ID NO: 18 - protein, 1384 aa, CoriobacteriumglomeransPW2
MKLRGIEDDYSIGLDMGTSSVGWAVTDERGTLAHFKRKPTWGSRLFREAQTAAVARMPRGQRRRYVRRRWRLDLLQKLFEQQMEQADPDFFIRLRQSRLLRDDRAEEHADYRWPLFNDCKFTERDYYQRFPTIYHVRSWLMETDEQADIRLIYLALHNIVKHRGNFLREGQSLSAKSARPDEALNHLRETLRVWSSERGFECSIADNGSILAMLTHPDLSPSDRRKKIAPLFDVKSDDAAADKKLGIALAGAVIGLKTEFKNIFGDFPCEDSSIYLSNDEAVDAVRSACPDDCAELFDRLCEVYSAYVLQGLLSYAPGQTISANMVEKYRRYGEDLALLKKLVKIYAPDQYRMFFSGATYPGTGIYDAAQARGYTKYNLGPKKSEYKPSESMQYDDFRKAVEKLFAKTDARADERYRMMMDRFDKQQFLRRLKTSDNGSIYHQLHLEELKAIVENQGRFYPFLKRDADKLVSLVSFRIPYYVGPLSTRNARTDQHGENRFAWSERKPGMQDEPIFPWNWESIIDRSKSAEKFILRMTGMCTYLQQEPVLPKSSLLYEEFCVLNELNGAHWSIDGDDEHRFDAADREGIIEELFRRKRTVSYGDVAGWMERERNQIGAHVCGGQGEKGFESKLGSYIFFCKDVFKVERLEQSDYPMIERIILWNTLFEDRKILSQRLKEEYGSRLSAEQIKTICKKRFTGWGRLSEKFLTGITVQVDEDSVSIMDVLREGCPVSGKRGRAMVMMEILRDEELGFQKKVDDFNRAFFAENAQALGVNELPGSPAVRRSLNQSIRIVDEIASIAGKAPANIFIEVTRDEDPKKKGRRTKRRYNDLKDALEAFKKEDPELWRELCETAPNDMDERLSLYFMQRGKCLYSGRAIDIHQLSNAGIYEVDHIIPRTYVKDDSLENKALVYREENQRKTDMLLIDPEIRRRMSGYWRMLHEAKLIGDKKFRNLLRSRIDDKALKGFIARQLVETGQMVKLVRSLLEARYPETNIISVKASISHDLRTAAELVKCREANDFHHAHDAFLACRVGLFIQKRHPCVYENPIGLSQVVRNYVRQQADIFKRCRTIPGSSGFIVNSFMTSGFDKETGEIFKDDWDAEAEVEGIRRSLNFRQCFISRMPFEDHGVFWDATIYSPRAKKTAALPLKQGLNPSRYGSFSREQFAYFFIYKARNPRKEQTLFEFAQVPVRLSAQIRQDENALERYARELAKDQGLEFIRIERSKILKNQLIEIDGDRLCITGKEEVRNACELAFAQDEMRVIRMLVSEKPVSRECVISLFNRILLHGDQASRRLSKQLKLALLSEAFSEASDNVQRNVVLGLIAIFNGSTNMVNLSDIGGSKFAGNVRIKYKKELASPKVNVHLIDQSVTGMFERRTKIGL

SEQ ID NO: 19 - protein, 1391 aa, Eubacterium yurii ATCC 43715
MENKQYYIGLDVGTNSVGWAVTDTSYNLLRAKGKDMWGARLFEKANTAAERRTKRTSRRRSEREKARKAMLKELFADEINRVDPSFFIRLEESKFFLDDRSENNRQRYTLFNDATFTDKDYYEKYKTIFHLRSALINSDEKFDVRLVFLAILNLFSHRGHFLNASLKGDGDIQGMDVFYNDLVESCEYFEIELPRITNIDNFEKILSQKGKSRTKILEELSEELSISKKDKSKYNLIKLISGLEASVVELYNIEDIQDENKKIKIGFRESDYEESSLKVKEIIGDEYFDLVERAKSVHDMGLLSNIIGNSKYLCEARVEAYENHHKDLLKIKELLKKYDKKAYNDMFRKMTDKNYSAYVGSVNSNIAKERRSVDKRKIEDLYKYIEDTALKNIPDDNKDKIEILEKIKLGEFLKKQLTASNGVIPNQLQSRELRAILKKAENYLPFLKEKGEKNLTVSEMIIQLFEFQIPYYVGPLDKNPKKDNKANSWAKIKQGGRILPWNFEDKVDVKGSRKEFIEKMVRKCTYISDEHTLPKQSLLYEKFMVLNEINNIKIDGEKISVEAKQKIYNDLFVKGKKVSQKDIKKELISLNIMDKDSVLSGTDTVCNAYLSSIGKFTGVFKEEINKQSIVDMIEDIIFLKTVYGDEKRFVKEEIVEKYGDEIDKDKIKRILGFKFSNWGNLSKSFLELEGADVGTGEVRSIIQSLWETNFNLMELLSSRFTYMDELEKRVKKLEKPLSEWTIEDLDDMYLSSPVKRMIWQSMKIVDEIQTVIGYAPKRIFVEMTRSEGEKVRTKSRKDRLKELYNGIKEDSKQWVKELDSKDESYFRSKKMYLYYLQKGRCMYSGEVIELDKLMDDNLYDIDHIYPRSFVKDDSLDNLVLVKKEINNRKQNDPITPQIQASCQGFWKILHDQGFMSNEKYSRLTRKTQEFSDEEKLSFINRQIVETGQATKCMAQILQKSMGEDVDVVFSKARLVSEFRHKFELFKSRLINDFHHANDAYLNIVVGNSYFVKFTRNPANFIKDARKNPDNPVYKYHMDRFFERDVKSKSEVAWIGQSEGNSGTIVIVKKTMAKNSPLITKKVEEGHGSITKETIVGVKEIKFGRNKVEKADKTPKKPNLQAYRPIKTSDERLCNILRYGGRTSISISGYCLVEYVKKRKTIRSLEAIPVYLGRKDSLSEEKLLNYFRYNLNDGGKDSVSDIRLCLPFISTNSLVKIDGYLYYLGGKNDDRIQLYNAYQLKMKKEEVEYIRKIEKAVSMSKFDEIDREKNPVLTEEKNIELYNKIQDKFENTVFSKRMSLVKYNKKDLSFGDFLKNKKSKFEEIDLEKQCKVLYNIIFNLSNLKEVDLSDIGGSKSTGKCRCKKNITNYKEFKLIQQSITGLYSCEKDLMTI

SEQ ID NO: 20 - protein, 1364 aa, Peptoniphilus duerdenii ATCC BAA-1640
MKNLKEYYIGLDIGTASVGWAVTDESYNIPKFNGKKMWGVRLFDDAKTAEERRTQRGSRRRLNRRKERINLLQDLFATEISKVDPNFFLRLDNSDLYREDKDEKLKSKYTLFNDKDFKDRDYHKKYPTIHHLIMDLIEDEGKKDIRLLYLACHYLLKNRGHFIFEGQKFDTKNSFDKSINDLKIHLRDEYNIDLEFNNEDLIEIITDTTLNKTNKKKELKNIVGDTKFLKAISAIMIGSSQKLVDLFEDGEFEETTVKSVDFSTTAFDDKYSEYEEALGDTISLLNILKSIYDSSILENLLKDADKSKDGNKYISKAFVKKFNKHGKDLKTLKRIIKKYLPSEYANIFRNKSINDNYVAYTKSNITSNKRTKASKFTKQEDFYKFIKKHLDTIKETKLNSSENEDLKLIDEMLTDIEFKTFIPKLKSSDNGVIPYQLKLMELKKILDNQSKYYDFLNESDEYGTVKDKVESIMEFRIPYYVGPLNPDSKYAWIKRENTKITPWNFKDIVDLDSSREEFIDRLIGRCTYLKEEKVLPKASLIYNEFMVLNELNNLKLNEFLITEEMKKAIFEELFKTKKKVTLKAVSNLLKKEFNLTGDILLSGTDGDFKQGLNSYIDFKNIIGDKVDRDDYRIKIEEIIKLIVLYEDDKTYLKKKIKSAYKNDFTDDEIKKIAALNYKDWGRLSKRFLTGIEGVDKTTGEKGSIIYFMREYNLNLMELMSGHYTFTEEVEKLNPVENRELCYEMVDELYLSPSVKRMLWQSLRVVDEIKRIIGKDPKKIFIEMARAKEAKNSRKESRKNKLLEFYKFGKKAFINEIGEERYNYLLNEINSEEESKFRWDNLYLYYTQLGRCMYSLEPIDLADLKSNNIYDQDHIYPKSKIYDDSLENRVLVKKNLNHEKGNQYPIPEKVLNKNAYGFWKILFDKGLIGQKKYTRLTRRTPFEERELAEFIERQIVETRQATKETANLLKNICQDSEIVYSKAENASRFRQEFDIIKCRTVNDLHHMHDAYLNIVVGNVYNTKFTKNPLNFIKDKDNVRSYNLENMFKYDVVRGSYTAWIADDSEGNVKAATIKKVKRELEGKNYRFTRMSYIGTGGLYDQNLMRKGKGQIPQKENTNKSNIEKYGGYNKASSAYFALIESDGKAGRERTLETIPIMVYNQEKYGNTEAVDKYLKDNLELQDPKILKDKIKINSLIKLDGFLYNIKGKTGDSLSIAGSVQLIVNKEEQKLIKKMDKFLVKKKDNKDIKVTSFDNIKEEELIKLYKTLSDKLNNGIYSNKRNNQAKNISEALDKFKEISIEEKIDVLNQIILLFQSYNNGCNLKSIGLSAKTGVVFIPKKLNYKECKLINQSITGLFENEVDLLNL

SEQ ID NO: 21 - protein, 1358 aa, Acidaminococcus sp. D21
MGKMYYLGLDIGTNSVGYAVTDPSYHLLKFKGEPMWGAHVFAAGNQSAERRSFRTSRRRLDRRQQRVKLVQEIFAPVISPIDPRFFIRLHESALWRDDVAETDKHIFFNDPTYTDKEYYSDYPTIHHLIVDLMESSEKHDPRLVYLAVAWLVAHRGHFLNEVDKDNIGDVLSFDAFYPEFLAFLSDNGVSPWVCESKALQATLLSRNSVNDKYKALKSLIFGSQKPEDNFDANISEDGLIQLLAGKKVKVNKLFPQESNDASFTLNDKEDAIEEILGTLTPDECEWIAHIRRLFDWAIMKHALKDGRTISESKVKLYEQHHHDLTQLKYFVKTYLAKEYDDIFRNVDSETTKNYVAYSYHVKEVKGTLPKNKATQEEFCKYVLGKVKNIECSEADKVDFDEMIQRLTDNSFMPKQVSGENRVIPYQLYYYELKTILNKAASYLPFLTQCGKDAISNQDKLLSIMTFRIPYFVGPLRKDNSEHAWLERKAGKIYPWNFNDKVDLDKSEEAFIRRMTNTCTYYPGEDVLPLDSLIYEKFMILNEINNIRIDGYPISVDVKQQVFGLFEKKRRVTVKDIQNLLLSLGALDKHGKLTGIDTTIHSNYNTYHHFKSLMERGVLTRDDVERIVERMTYSDDTKRVRLWLNNNYGTLTADDVKHISRLRKHDFGRLSKMFLTGLKGVHKETGERASILDFMWNTNDNLMQLLSECYTFSDEITKLQEAYYAKAQLSLNDFLDSMYISNAVKRPIYRTLAVVNDIRKACGTAPKRIFIEMARDGESKKKRSVTRREQIKNLYRSIRKDFQQEVDFLEKILENKSDGQLQSDALYLYFAQLGRDMYTGDPIKLEHIKDQSFYNIDHIYPQSMVKDDSLDNKVLVQSEINGEKSSRYPLDAAIRNKMKPLWDAYYNHGLISLKKYQRLTRSTPFTDDEKWDFINRQLVETRQSTKALAILLKRKFPDTEIVYSKAGLSSDFRHEFGLVKSRNINDLHHAKDAFLAIVTGNVYHERFNRRWFMVNQPYSVKTKTLFTHSIKNGNFVAWNGEEDLGRIVKMLKQNKNTIHFTRFSFDRKEGLFDIQPLKASTGLVPRKAGLDVVKYGGYDKSTAAYYLLVRFTLEDKKTQHKLMMIPVEGLYKARIDHDKEFLTDYAQTTISEILQKDKQKVINIMFPMGTRHIKLNSMISIDGFYLSIGGKSSKGKSVLCHAMVPLIVPHKIECYIKAMESFARKFKENNKLRIVEKFDKITVEDNLNLYELFLQKLQHNPYNKFFSTQFDVLTNGRSTFTKLSPEEQVQTLLNILSIFKTCRSSGCDLKSINGSAQAARIMISADLTGLSKKYSDIRLVEQSASGLFVSKSQNLLEYL

SEQ ID NO: 22 - protein, 1356 aa, Lactobacillus farciminis KCTC 3681
MTKKEQPYNIGLDIGTSSVGWAVTNDNYDLLNIKKKNLWGVRLFEEAQTAKETRLNRSTRRRYRRRKNRINWLNEIFSEELAKTDPSFLIRLQNSWVSKKDPDRKRDKYNLFIDGPYTDKEYYREFPTIFHLRKELILNKDKADIRLIYLALHNILKYRGNFTYEHQKFNISNLNNNLSKELIELNQQLIKYDISFPDDCDWNHISDILIGRGNATQKSSNILKDFTLDKETKKLLKEVINLILGNVAHLNTIFKTSLTKDEEKLNFSGKDIESKLDDLDSILDDDQFTVLDAANRIYSTITLNEILNGESYFSMAKVNQYENHAIDLCKLRDMWHTTKNEEAVEQSRQAYDDYINKPKYGTKELYTSLKKFLKVALPTNLAKEAEEKISKGTYLVKPRNSENGVVPYQLNKIEMEKIIDNQSQYYPFLKENKEKLLSILSFRIPYYVGPLQSAEKNPFAWMERKSNGHARPWNFDEIVDREKSSNKFIRRMTVTDSYLVGEPVLPKNSLIYQRYEVLNELNNIRITENLKTNPIGSRLTVETKQRIYNELFKKYKKVTVKKLTKWLIAQGYYKNPILIGLSQKDEFNSTLTTYLDMKKIFGSSFMEDNKNYDQIEELIEWLTIFEDKQILNEKLHSSKYSYTPDQIKKISNMRYKGWGRLSKKILMDITTETNTPQLLQLSNYSILDLMWATNNNFISIMSNDKYDFKNYIENHNLNKNEDQNISDLVNDIHVSPALKRGITQSIKIVQEIVKFMGHAPKHIFIEVTRETKKSEITTSREKRIKRLQSKLLNKANDFKPQLREYLVPNKKIQEELKKHKNDLSSERIMLYFLQNGKSLYSEESLNINKLSDYQVDHILPRTYIPDDSLENKALVLAKENQRKADDLLLNSNVIDRNLERWTYMLNNNMIGLKKFKNLTRRVITDKDKLGFIHRQLVQTSQMVKGVANILDNMYKNQGTTCIQARANLSTAFRKALSGQDDTYHFKHPELVKNRNVNDFHHAQDAYLASFLGTYRLRRFPTNEMLLMNGEYNKFYGQVKELYSKKKKLPDSRKNGFIISPLVNGTTQYDRNTGEIIWNVGFRDKILKIFNYHQCNVTRKTEIKTGQFYDQTIYSPKNPKYKKLIAQKKDMDPNIYGGFSGDNKSSITIVKIDNNKIKPVAIPIRLINDLKDKKTLQNWLEENVKHKKSIQIIKNNVPIGQIIYSKKVGLLSLNSDREVANRQQLILPPEHSALLRLLQIPDEDLDQILAFYDKNILVEILQELITKMKKFYPFYKGEREFLIANIENFNQATTSEKVNSLEELITLLHANSTSAHLIFNNIEKKAFGRKTHGLTLNNTDFIYQSVTGLYETRIHIE

SEQ ID NO: 23 - protein, 1421 aa, Streptococcus sanguinis SK49
MTKFNKNYSIGLDIGVSSVGYAVVTEDYRVPAFKFKVLGNTEKEKIKKNLIGSTTFVSAQPAKGTRVFRVNRRRIDRRNHRITYLRDIFQKEIEKVDKNFYRRLDESFRVLGDKSEDLQIKQPFFGDKELETAYHKKYPTIYHLRKHLADADKNSPVADIREVYMAISHILKYRGHFLTLDKINPNNINMQNSWIDFIESCQEVFDLEISDESKNIADIFKSSENRQEKVKKILPYFQQELLKKDKSIFKQLLQLLFGLKTKFKDCFELEEEPDLNFSKENYDENLENFLGSLEEDFSDVFAKLKVLRDTILLSGMLTYTGATHARFSATMVERYEEHRKDLQRFKFFIKQNLSEQDYLDIFGRKTQNGFDVDKETKGYVGYITNKMVLTNPQKQKTIQQNFYDYISGKITGIEGAEYFLNKISDGTFLRKLRTSDNGAIPNQIHAYELEKIIERQGKDYPFLLENKDKLLSILTFKIPYYVGPLAKGSNSRFAWIKRATSSDILDDNDEDTRNGKIRPWNYQKLINMDETRDAFITNLIGNDIILLNEKVLPKRSLIYEEVMLQNELTRVKYKDKYGKAHFFDSELRQNIINGLFKNNSKRVNAKSLIKYLSDNHKDLNAIEIVSGVEKGKSFNSTLKTYNDLKTIFSEELLDSEIYQKELEEIIKVITVFDDKKSIKNYLTKFFGHLEILDEEKINQLSKLRYSGWGRYSAKLLLDIRDEDTGFNLLQFLRNDEENRNLTKLISDNTLSFEPKIKDIQSKSTIEDDIFDEIKKLAGSPAIKRGILNSIKIVDELVQIIGYPPHNIVIEMARENMTTEEGQKKAKTRKTKLESALKNIENSLLENGKVPHSDEQLQSEKLYLYYLQNGKDMYTLDKTGSPAPLYLDQLDQYEVDHIIPYSFLPIDSIDNKVLTHRENNQQKLNNIPDKETVANMKPFWEKLYNAKLISQTKYQRLTTSERTPDGVLTESMKAGFIERQLVETRQIIKHVARILDNRFSDTKIITLKSQLITNFRNTFHIAKIRELNDYHHAHDAYLAVVVGQTLLKVYPKLAPELIYGHHAHFNRHEENKATLRKHLYSNIMRFFNNPDSKVSKDIWDCNRDLPIIKDVIYNSQINFVKRTMIKKGAFYNQNPVGKFNKQLAANNRYPLKTKALCLDTSIYGGYGPMNSALSIIIIAERFNEKKGKIETVKEFHDIFIIDYEKFNNNPFQFLNDTSENGFLKKNNINRVLGFYRIPKYSLMQKIDGTRMLFESKSNLHKATQFKLTKTQNELFFHMKRLLTKSNLMDLKSKSAIKESQNFILKHKEEFDNISNQLSAFSQKMLGNTTSLKNLIKGYNERKIKEIDIRDETIKYFYDNFIKMFSFVKSGAPKDINDFFDNKCTVARMRPKPDKKLLNATLIHQSITGLYETRIDLSKLGED

SEQ ID NO: 24 - protein, 1338 aa, Coprococcus catus GD-7
MKQEYFLGLDMGTGSLGWAVTDSTYQVMRKHGKALWGTRLFESASTAEERRMFRTARRRLDRRNWRIQVLQEIFSEEISKVDPGFFLRMKESKYYPEDKRDAEGNCPELPYALFVDDNYTDKNYHKDYPTIYHLRKMLMETTEIPDIRLVYLVLHHMMKHRGHFLLSGDISQIKEFKSTFEQLIQNIQDEELEWHISLDDAAIQFVEHVLKDRNLTRSTKKSRLIKQLNAKSACEKAILNLLSGGTVKLSDIFNNKELDESERPKVSFADSGYDDYIGIVEAELAEQYYIIASAKAVYDWSVLVEILGNSVSISEAKIKVYQKHQADLKTLKKIVRQYMTKEDYKRVFVDTEEKLNNYSAYIGMTKKNGKKVDLKSKQCTQADFYDFLKKNVIKVIDHKEITQEIESEIEKENFLPKQVTKDNGVIPYQVHDYELKKILDNLGTRMPFIKENAEKIQQLFEFRIPYYVGPLNRVDDGKDGKFTWSVRKSDARIYPWNFTEVIDVEASAEKFIRRMTNKCTYLVGEDVLPKDSLVYSKFMVLNELNNLRLNGEKISVELKQRIYEELFCKYRKVTRKKLERYLVIEGIAKKGVEITGIDGDFKASLTAYHDFKERLTDVQLSQRAKEAIVLNVVLFGDDKKLLKQRLSKMYPNLTTGQLKGICSLSYQGWGRLSKTFLEEITVPAPGTGEVWNIMTALWQTNDNLMQLLSRNYGFTNEVEEFNTLKKETDLSYKTVDELYVSPAVKRQIWQTLKVVKEIQKVMGNAPKRVFVEMAREKQEGKRSDSRKKQLVELYRACKNEERDWITELNAQSDQQLRSDKLFLYYIQKGRCMYSGETIQLDELWDNTKYDIDHIYPQSKTMDDSLNNRVLVKKNYNAIKSDTYPLSLDIQKKMMSFWKMLQQQGFITKEKYVRLVRSDELSADELAGFIERQIVETRQSTKAVATILKEALPDTEIVYVKAGNVSNFRQTYELLKVREMNDLHHAKDAYLNIVVGNAYFVKFTKNAAWFIRNNPGRSYNLKRMFEFDIERSGEIAWKAGNKGSIVTVKKVMQKNNILVTRKAYEVKGGLFDQQIMKKGKGQVPIKGNDERLADIEKYGGYNKAAGTYFMLVKSLDKKGKEIRTIEFVPLYLKNQIEINHESAIQYLAQERGLNSPEILLSKIKIDTLFKVDGFKMWLSGRTGNQLIFKGANQLILSHQEAAILKGVVKYVNRKNENKDAKLSERDGMTEEKLLQLYDTFLDKLSNTVYSIRLSAQIKTLTEKRAKFIGLSNEDQCIVLNEILHMFQCQSGSANLKLIGGPGSAGILVMNNNITACKQISVINQSPTGIYEKEIDLIKL

SEQ ID NO: 25 - protein, 1345 aa, Streptococcus mutans UA159
MKKPYSIGLDIGTNSVGWAVVTDDYKVPAKKMKVLGNTDKSHIEKNLLGALLFDSGNTAEDRRLKRTARRRYTRRRNRILYLQEIFSEEMGKVDDSFFHRLEDSFLVTEDKRGERHPIFGNLEEEVKYHENFPTIYHLRQYLADNPEKVDLRLVYLALAHIIKFRGHFLIEGKFDTRNNDVQRLFQEFLAVYDNTFENSSLQEQNVQVEEILTDKISKSAKKDRVLKLFPNEKSNGRFAEFLKLIVGNQADFKKHFELEEKAPLQFSKDTYEEELEVLLAQIGDNYAELFLSAKKLYDSILLSGILTVTDVGTKAPLSASMIQRYNEHQMDLAQLKQFIRQKLSDKYNEVFSDVSKDGYAGYIDGKTNQEAFYKYLKGLLNKIEGSGYFLDKIEREDFLRKQRTFDNGSIPHQIHLQEMRAIIRRQAEFYPFLADNQDRIEKLLTFRIPYYVGPLARGKSDFAWLSRKSADKITPWNFDEIVDKESSAEAFINRMTNYDLYLPNQKVLPKHSLLYEKFTVYNELTKVKYKTEQGKTAFFDANMKQEIFDGVFKVYRKVTKDKLMDFLEKEFDEFRIVDLTGLDKENKVFNASYGTYHDLCKILDKDFLDNSKNEKILEDIVLTLTLFEDREMIRKRLENYSDLLTKEQVKKLERRHYTGWGRLSAELIHGIRNKESRKTILDYLIDDGNSNRNFMQLINDDALSFKEEIAKAQVIGETDNLNQVVSDIAGSPAIKKGILQSLKIVDELVKIMGHQPENIVVEMARENQFTNQGRRNSQQRLKGLTDSIKEFGSQILKEHPVENSQLQNDRLFLYYLQNGRDMYTGEELDIDYLSQYDIDHIIPQAFIKDNSIDNRVLTSSKENRGKSDDVPSKDVVRKMKSYWSKLLSAKLITQRKFDNLTKAERGGLTDDDKAGFIKRQLVETRQITKHVARILDERFNTETDENNKKIRQVKIVTLKSNLVSNFRKEFELYKVREINDYHHAHDAYLNAVIGKALLGVYPQLEPEFVYGDYPHFHGHKENKATAKKFFYSNIMNFFKKDDVRTDKNGEIIWKKDEHISNIKKVLSYPQVNIVKKVEEQTGGFSKESILPKGNSDKLIPRKTKKFYWDTKKYGGFDSPIVAYSILVIADIEKGKSKKLKTVKALVGVTIMEKMTFERDPVAFLERKGYRNVQEENIIKLPKYSLFKLENGRKRLLASARELQKGNEIVLPNHLGTLLYHAKNIHKVDEPKHLDYVDKHKDEFKELLDVVSNFSKKYTLAEGNLEKIKELYAQNNGEDLKELASSFINLLTFTAIGAPATFKFFDKNIDRKRYTSTTEILNATLIHQSITGLYETRIDLNKLGGD

SEQ ID NO: 26 - protein, 1368 aa, Streptococcus pyogenes M1 GAS [sequence omitted]

SEQ ID NO: 27 - protein, 1388 aa, Streptococcus thermophilus LMD-9
MTKPYSIGLDIGTNSVGWAVTTDNYKVPSKKMKVLGNTSKKYIKKNLLGVLLFDSGITAEGRRLKRTARRRYTRRRNRILYLQEIFSTEMATLDDAFFQRLDDSFLVPDDKRDSKYPIFGNLVEEKAYHDEFPTIYHLRKYLADSTKKADLRLVYLALAHMIKYRGHFLIEGEFNSKNNDIQKNFQDFLDTYNAIFESDLSLENSKQLEEIVKDKISKLEKKDRILKLFPGEKNSGIFSEFLKLIVGNQADFRKCFNLDEKASLHFSKESYDEDLETLLGYIGDDYSDVFLKAKKLYDAILLSGFLTVTDNETEAPLSSAMIKRYNEHKEDLALLKEYIRNISLKTYNEVFKDDTKNGYAGYIDGKTNQEDFYVYLKKLLAEFEGADYFLEKIDREDFLRKQRTFDNGSIPYQIHLQEMRAILDKQAKFYPFLAKNKERIEKILTFRIPYYVGPLARGNSDFAWSIRKRNEKITPWNFEDVIDKESSAEAFINRMTSFDLYLPEEKVLPKHSLLYETFNVYNELTKVRFIAESMRDYQFLDSKQKKDIVRLYFKDKRKVTDKDIIEYLHAIYGYDGIELKGIEKQFNSSLSTYHDLLNIINDKEFLDDSSNEAIIEEIIHTLTIFEDREMIKQRLSKFENIFDKSVLKKLSRRHYTGWGKLSAKLINGIRDEKSGNTILDYLIDDGISNRNFMQLIHDDALSFKKKIQKAQIIGDEDKGNIKEVVKSLPGSPAIKKGILQSIKIVDELVKVMGGRKPESIVVEMARENQYTNQGKSNSQQRLKRLEKSLKELGSKILKENIPAKLSKIDNNALQNDRLYLYYLQNGKDMYTGDDLDIDRLSNYDIDHIIPQAFLKDNSIDNKVLVSSASNRGKSDDVPSLEVVKKRKTFWYQLLKSKLISQRKFDNLTKAERGGLSPEDKAGFIQRQLVETRQITKHVARLLDEKFNNKKDENNRAVRTVKIITLKSTLVSQFRKDFELYKVREINDFHHAHDAYLNAVVASALLKKYPKLEPEFVYGDYPKYNSFRERKSATEKVYFYSNIMNIFKKSISLADGRVIERPLIEVNEETGESVWNKESDLATVRRVLSYPQVNVVKKVEEQNHGLDRGKPKGLFNANLSSKPKPNSNENLVGAKEYLDPKKYGGYAGISNSFTVLVKGTIEKGAKKKITNVLEFQGISILDRINYRKDKLNFLLEKGYKDIELIIELPKYSLFELSDGSRRMLASILSTNNKRGEIHKGNQIFLSQKFVKLLYHAKRISNTINENHRKYVENHKKEFEELFYYILEFNENYVGAKKNGKLLNSAFQSWQNHSIDELCSSFIGPTGSERKGLFELTSRGSAADFEFLGVKIPRYRDYTPSSLLKDATLIHQSVTGLYETRIDLAKLGEG

SEQ ID NO: 28 - protein, 1374 aa, Fusobacterium nucleatum ATCC49256
MKKQKFSDYYLGFDIGTNSVGWCVTDLDYNVLRFNKKDMWGSRLFDEAKTAAERRVQRNSRRRLKRRKWRLNLLEEIFSDEIMKIDSNFFRRLKESSLWLEDKNSKEKFTLFNDDNYKDYDFYKQYPTIFHLRDELIKNPEKKDIRLIYLALHSIFKSRGHFLFEGQNLKEIKNFETLYNNLISFLEDNGINKSIDKDNIEKLEKIICDSGKGLKDKEKEFKGIFNSDKQLVAIFKLSVGSSVSLNDLFDTDEYKKEEVEKEKISFREQIYEDDKPIYYSILGEKIELLDIAKSFYDFMVLNNILSDSNYISEAKVKLYEEHKKDLKNLKYIIRKYNKENYDKLFKDKNENNYPAYIGLNKEKDKKEVVEKSRLKIDDLIKVIKGYLPKPERIEEKDKTIFNEILNKIELKTILPKQRISDNGTLPYQIHEVELEKILENQSKYYDFLNYEENGVSTKDKLLKTFKFRIPYYVGPLNSYHKDKGGNSWIVRKEEGKILPWNFEQKVDIEKSAEEFIKRMTNKCTYLNGEDVIPKDSFLYSEYIILNELNKVQVNDEFLNEENKRKIIDELFKENKKVSEKKFKEYLLVNQIANRTVELKGIKDSFNSNYVSYIKFKDIFGEKLNLDIYKEISEKSILWKCLYGDDKKIFEKKIKNEYGDILNKDEIKKINSFKFNTWGRLSEKLLTGIEFINLETGECYSSVMEALRRTNYNLMELLSSKFTLQESIDNENKEMNEVSYRDLIEESYVSPSLKRAILQTLKIYEEIKKITGRVPKKVFIEMARGGDESMKNKKIPARQEQLKKLYDSCGNDIANFSIDIKEMKNSLSSYDNNSLRQKKLYLYYLQFGKCMYTGREIDLDRLLQNNDTYDIDHIYPRSKVIKDDSFDNLVLVLKNENAEKSNEYPVKKEIQEKMKSFWRFLKEKNFISDEKYKRLTGKDDFELRGFMARQLVNVRQTTKEVGKILQQIEPEIKIVYSKAEIASSFREMFDFIKVRELNDTHHAKDAYLNIVAGNVYNTKFTEKPYRYLQEIKENYDVKKIYNYDIKNAWDKENSLEIVKKNMEKNTVNITRFIKEEKGELFNLNPIKKGETSNEIISIKPKLYDGKDNKLNEKYGYYTSLKAAYFIYVEHEKKNKKVKTFERITRIDSTLIKNEKNLIKYLVSQKKLLNPKIIKKIYKEQTLIIDSYPYTFTGVDSNKKVELKNKKQLYLEKKYEQILKNALKFVEDNQGETEENYKFIYLKKRNNNEKNETIDAVKERYNIEFNEMYDKFLEKLSSKDYKNYINNKLYTNFLNSKEKFKKLKLWEKSLILREFLKIFNKNTYGKYEIKDSQTKEKLFSFPEDTGRIRLGQSSLGNNKELLEESVTGLFVKKIKL

SEQ ID NO: 29 - protein, 1333 aa, Planococcus antarcticus DSM 14505
MKNYTIGLDIGVASVGWVCIDENYKILNYNNRHAFGVHEFESAESAAGRRLKRGMRRRYNRRKKRLQLLQSLFDSYITDSGFFSKTDSQHFWKNNNEFENRSLTEVLSSLRISSRKYPTIYHLRSDLIESNKKMDLRLVYLALHNLVKYRGHFLQEGNWSEAASAEGMDDQLLELVTRYAELENLSPLDLSESQWKAAETLLLNRNLTKTDQSKELTAMFGKEYEPFCKLVAGLGVSLHQLFPSSEQALAYKETKTKVQLSNENVEEVMELLLEEESALLEAVQPFYQQVVLYELLKGETYVAKAKVSAFKQYQKDMASLKNLLDKTFGEKVYRSYFISDKNSQREYQKSHKVEVLCKLDQFNKEAKFAETFYKDLKKLLEDKSKTSIGTTEKDEMLRIIKAIDSNQFLQKQKGIQNAAIPHQNSLYEAEKILRNQQAHYPFITTEWIEKVKQILAFRIPYYIGPLVKDTTQSPFSWVERKGDAPITPWNFDEQIDKAASAEAFISRMRKTCTYLKGQEVLPKSSLTYERFEVLNELNGIQLRTTGAESDFRHRLSYEMKCWIIDNVFKQYKTVSTKRLLQELKKSPYADELYDEHTGEIKEVFGTQKENAFATSLSGYISMKSILGAVVDDNPAMTEELIYWIAVFEDREILHLKIQEKYPSITDVQRQKLALVKLPGWGRFSRLLIDGLPLDEQGQSVLDHMEQYSSVFMEVLKNKGFGLEKKIQKMNQHQVDGTKKIRYEDIEELAGSPALKRGIWRSVKIVEELVSIFGEPANIVLEVAREDGEKKRTKSRKDQWEELTKTTLKNDPDLKSFIGEIKSQGDQRFNEQRFWLYVTQQGKCLYTGKALDIQNLSMYEVDHILPQNFVKDDSLDNLALVMPEANQRKNQVGQNKMPLEIIEANQQYAMRTLWERLHELKLISSGKLGRLKKPSFDEVDKDKFIARQLVETRQIIKHVRDLLDERFSKSDIHLVKAGIVSKFRRFSEIPKIRDYNNKHHAMDALFAAALIQSILGKYGKNFLAFDLSKKDRQKQWRSVKGSNKEFFLFKNFGNLRLQSPVTGEEVSGVEYMKHVYFELPWQTTKMTQTGDGMFYKESIFSPKVKQAKYVSPKTEKFVHDEVKNHSICLVEFTFMKKEKEVQETKFIDLKVIEHHQFLKEPESQLAKFLAEKETNSPIIHARIIRTIPKYQKIWIEHFPYYFISTRELHNARQFEISYELMEKVKQLSERSSVEELKIVFGLLIDQMNDNYPIYTKSSIQDRVQKFVDTQLYDFKSFEIGFEELKKAVAANAQRSDTFGSRISKKPKPEEVAIGYESITGLKYRKPRSVVGTKR

SEQ ID NO: 30 - protein, 1395 aa, Treponema denticola ATCC 35405
MKKEIKDYFLGLDVGTGSVGWAVTDTDYKLLKANRKDLWGMRCFETAETAEVRRLHRGARRRIERRKKRIKLLQELFSQEIAKTDEGFFQRMKESPFYAEDKTILQENTLFNDKDFADKTYHKAYPTINHLIKAWIENKVKPDPRLLYLACHNIIKKRGHFLFEGDFDSENQFDTSIQALFEYLREDMEVDIDADSQKVKEILKDSSLKNSEKQSRLNKILGLKPSDKQKKAITNLISGNKINFADLYDNPDLKDAEKNSISFSKDDFDALSDDLASILGDSFELLLKAKAVYNCSVLSKVIGDEQYLSFAKVKIYEKHKTDLTKLKNVIKKHFPKDYKKVFGYNKNEKNNNNYSGYVGVCKTKSKKLIINNSVNQEDFYKFLKTILSAKSEIKEVNDILTEIETGTFLPKQISKSNAEIPYQLRKMELEKILSNAEKHFSFLKQKDEKGLSHSEKIIMLLTFKIPYYIGPINDNHKKFFPDRCWVVKKEKSPSGKTTPWNFFDHIDKEKTAEAFITSRTNFCTYLVGESVLPKSSLLYSEYTVLNEINNLQIIIDGKNICDIKLKQKIYEDLFKKYKKITQKQISTFIKHEGICNKTDEVIILGIDKECTSSLKSYIELKNIFGKQVDEISTKNMLEEIIRWATIYDEGEGKTILKTKIKAEYGKYCSDEQIKKILNLKFSGWGRLSRKFLETVTSEMPGFSEPVNIITAMRETQNNLMELLSSEFTFTENIKKINSGFEDAEKQFSYDGLVKPLFLSPSVKKMLWQTLKLVKEISHITQAPPKKIFIEMAKGAELEPARTKTRLKILQDLYNNCKNDADAFSSEIKDLSGKIENEDNLRLRSDKLYLYYTQLGKCMYCGKPIEIGHVFDTSNYDIDHIYPQSKIKDDSISNRVLVCSSCNKNKEDKYPLKSEIQSKQRGFWNFLQRNNFISLEKLNRLTRATPISDDETAKFIARQLVETRQATKVAAKVLEKMFPETKIVYSKAETVSMFRNKFDIVKCREINDFHHAHDAYLNIVVGNVYNTKFTNNPWNFIKEKRDNPKIADTYNYYKVFDYDVKRNNITAWEKGKTIITVKDMLKRNTPIYTRQAACKKGELFNQTIMKKGLGQHPLKKEGPFSNISKYGGYNKVSAAYYTLIEYEEKGNKIRSLETIPLYLVKDIQKDQDVLKSYLTDLLGKKEFKILVPKIKINSLLKINGFPCHITGKTNDSFLLRPAVQFCCSNNEVLYFKKIIRFSEIRSQREKIGKTISPYEDLSFRSYIKENLWKKTKNDEIGEKEFYDLLQKKNLEIYDMLLTKHKDTIYKKRPNSATIDILVKGKEKFKSLIIENQFEVILEILKLFSATRNVSDLQHIGGSKYSGVAKIGNKISSLDNCILIYQSITGIFEKRIDLLKV

SEQ ID NO: 31 - protein, 1327 aa, Solobacterium moorei F0204
MEGQMKNNGNNLQQGNYYLGLDVGTSSVGWAVTDTDYNVLKFRGKSMWGARLFDEASTAEERRTHRGNRRRLARRKYRLLLLEQLFEKEIRKIDDNFFVRLHESNLWADDKSKPSKFLLFNDTNFTDKDYLKKYPTIYHLRSDLIHNSTEHDIRLVFLALHHLIKYRGHFIYDNSANGDVKTLDEAVSDFEEYLNENDIEFNIENKKEFINVLSDKHLTKKEKKISLKKLYGDITDSENINISVLIEMLSGSSISLSNLFKDIEFDGKQNLSLDSDIEETLNDVVDILGDNIDLLIHAKEVYDIAVLTSSLGKHKYLCDAKVELFEKNKKDLMILKKYIKKNHPEDYKKIFSSPTEKKNYAAYSQTNSKNVCSQEEFCLFIKPYIRDMVKSENEDEVRIAKEVEDKSFLTKLKGTNNSVVPYQIHERELNQILKNIVAYLPFMNDEQEDISVVDKIKLIFKFKIPYYVGPLNTKSTRSWVYRSDEKIYPWNFSNVIDLDKTAHEFMNRLIGRCTYTNDPVLPMDSLLYSKYNVLNEINPIKVNGKAIPVEVKQAIYTDLFENSKKKVTRKSIYIYLLKNGYIEKEDIVSGIDIEIKSKLKSHHDFTQIVQENKCTPEEIERIIKGILVYSDDKSMLRRWLKNNIKGLSENDVKYLAKLNYKEWGRLSKTLLTDIYTINPEDGEACSILDIMWNTNATLMEILSNEKYQFKQNIENYKAENYDEKQNLHEELDDMYISPAARRSIWQALRIVDEIVDIKKSAPKKIFIEMAREKKSAMKKKRTESRKDTLLELYKSCKSQADGFYDEELFEKLSNESNSRLRRDQLYLYYTQMGRSMYTGKRIDFDKLINDKNTYDIDHIYPRSKIKDDSITNRVLVEKDINGEKTDIYPISEDIRQKMQPFWKILKEKGLINEEKYKRLTRNYELTDEELSSFVARQLVETQQSTKALATLLKKEYPSAKIVYSKAGNVSEFRNRKDKELPKFREINDLHHAKDAYLNIVVGNVYDTKFTEKFFNNIRNENYSLKRVFDFSVPGAWDAKGSTFNTIKKYMAKNNPIIAFAPYEVKGELFDQQIVPKGKGQFPIKQGKDIEKYGGYNKLSSAFLFAVEYKGKKARERSLETVYIKDVELYLQDPIKYCESVLGLKEPQIIKPKILMGSLFSINNKKLVVTGRSGKQYVCHHIYQLSINDEDSQYLKNIAKYLQEEPDGNIERQNILNITSVNNIKLFDVLCTKFNSNTYEIILNSLKNDVNEGREKFSELDILEQCNILLQLLKAFKCNRESSNLEKLNNKKQAGVIVIPHLFTKCSVFKVIHQSITGLFEKEMDLLK

SEQ ID NO: 32 - protein, 1334 aa, Staphylococcus pseudintermedius ED99
MGRKPYILSLDIGTGSVGYACMDKGFNVLKYHDKDALGVYLFDGALTAQERRQFRTSRRRKNRRIKRLGLLQELLAPLVQNPNFYQFQRQFAWKNDNMDFKNKSLSEVLSFLGYESKKYPTIYHLQEALLLKDEKFDPELIYMALYHLVKYRGHFLFDHLKIENLTNNDNMHDFVELIETYENLNNIKLNLDYEKTKVIYEILKDNEMTKNDRAKRVKNMEKKLEQFSIMLLGLKFNEGKLFNHADNAEELKGANQSHTFADNYEENLTPFLTVEQSEFIERANKIYLSLTLQDILKGKKSMAMSKVAAYDKFRNELKQVKDIVYKADSTRTQFKKIFVSSKKSLKQYDATPNDQTFSSLCLFDQYLIRPKKQYSLLIKELKKIIPQDSELYFEAENDTLLKVLNTTDNASIPMQINLYEAETILRNQQKYHAEITDEMIEKVLSLIQFRIPYYVGPLVNDHTASKFGWMERKSNESIKPWNFDEVVDRSKSATQFIRRMTNKCSYLINEDVLPKNSLLYQEMEVLNELNATQIRLQTDPKNRKYRMMPQIKLFAVEHIFKKYKTVSHSKFLEIMLNSNHRENFMNHGEKLSIFGTQDDKKFASKLSSYQDMTKIFGDIEGKRAQIEEIIQWITIFEDKKILVQKLKECYPELTSKQINQLKKLNYSGWGRLSEKLLTHAYQGHSIIELLRHSDENFMEILTNDVYGFQNFIKEENQVQSNKIQHQDIANLTTSPALKKGIWSTIKLVRELTSIFGEPEKIIMEFATEDQQKGKKQKSRKQLWDDNIKKNKLKSVDEYKYIIDVANKLNNEQLQQEKLWLYLSQNGKCMYSGQSIDLDALLSPNATKHYEVDHIFPRSFIKDDSIDNKVLVIKKMNQTKGDQVPLQFIQQPYERIAYWKSLNKAGLISDSKLHKLMKPEFTAMDKEGFIQRQLVETRQISVHVRDFLKEEYPNTKVIPMKAKMVSEFRKKFDIPKIRQMNDAHHAIDAYLNGVVYHGAQLAYPNVDLFDFNFKWEKVREKWKALGEFNTKQKSRELFFFKKLEKMEVSQGERLISKIKLDMNHFKINYSRKLANIPQQFYNQTAVSPKTAELKYESNKSNEVVYKGLTPYQTYVVAIKSVNKKGKEKMEYQMIDHYVFDFYKFQNGNEKELALYLAQRENKDEVLDAQIVYSLNKGDLLYINNHPCYFVSRKEVINAKQFELTVEQQLSLYNVMNNKETNVEKLLIEYDFIAEKVINEYHHYLNSKLKEKRVRTFFSESNQTHEDFIKALDELFKVVTASATRSDKIGSRKNSMTHRAFLGKGKDVKIAYTSISGLKTTKPKSLFKLAESRNEL

SEQ ID NO: 33 - protein, 1472 aa, Flavobacterium branchiophilum FL-15
MAKILGLDLGTNSIGWAVVERENIDFSLIDKGVRIFSEGVKSEKGIESSRAAERTGYRSARKIKYRRKLRKYETLKVLSLNRMCPLSIEEVEEWKKSGFKDYPLNPEFLKWLSTDEESNVNPYFFRDRASKHKVSLFELGRAFYHIAQRRGFLSNRLDQSAEGILEEHCPKIEAIVEDLISIDEISTNITDYFFETGILDSNEKNGYAKDLDEGDKKLVSLYKSLLAILKKNESDFENCKSEIIERLNKKDVLGKVKGKIKDISQAMLDGNYKTLGQYFYSLYSKEKIRNQYTSREEHYLSEFITICKVQGIDQINEEEKINEKKFDGLAKDLYKAIFFQRPLKSQKGLIGKCSFEKSKSRCAISHPDFEEYRMWTYLNTIKIGTQSDKKLRFLTQDEKLKLVPKFYRKNDFNFDVLAKELIEKGSSFGFYKSSKKNDFFYWFNYKPTDTVAACQVAASLKNAIGEDWKTKSFKYQTINSNKEQVSRTVDYKDLWHLLTVATSDVYLYEFAIDKLGLDEKNAKAFSKTKLKKDFASLSLSAINKILPYLKEGLLYSHAVFVANIENIVDENIWKDEKQRDYIKTQISEIIENYTLEKSRFEIINGLLKEYKSENEDGKRVYYSKEAEQSFENDLKKKLVLFYKSNEIENKEQQETIFNELLPIFIQQLKDYEFIKIQRLDQKVLIFLKGKNETGQIFCTEEKGTAEEKEKKIKNRLKKLYHPSDIEKFKKKIIKDEFGNEKIVLGSPLTPSIKNPMAMRALHQLRKVLNALILEGQIDEKTIIHIEMARELNDANKRKGIQDYQNDNKKFREDAIKEIKKLYFEDCKKEVEPTEDDILRYQLWMEQNRSEIYEEGKNISICDIIGSNPAYDIEHTIPRSRSQDNSQMNKTLCSQRFNREVKKQSMPIELNNHLEILPRIAHWKEEADNLTREIEIISRSIKAAATKEIKDKKIRRRHYLTLKRDYLQGKYDRFIWEEPKVGFKNSQIPDTGIITKYAQAYLKSYFKKVESVKGGMVAEFRKIWGIQESFIDENGMKHYKVKDRSKHTHHTIDAITIACMTKEKYDVLAHAWTLEDQQNKKEARSIIEASKPWKTFKEDLLKIEEEILVSHYTPDNVKKQAKKIVRVRGKKQFVAEVERDVNGKAVPKKAASGKTIYKLDGEGKKLPRLQQGDTIRGSLHQDSIYGAIKNPLNTDEIKYVIRKDLESIKGSDVESIVDEVVKEKIKEAIANKVLLLSSNAQQKNKLVGTVWMNEEKRIAINKVRIYANSVKNPLHIKEHSLLSKSKHVHKQKVYGQNDENYAMAIYELDGKRDFELINIFNLAKLIKQGQGFYPLHKKKEIKGKIVFVPIEKRNKRDVVLKRGQQVVFYDKEVENPKDISEIVDFKGRIYIIEGLSIQRIVRPSGKVDEYGVIMLRYFKEARKADDIKQDNFKPDGVFKLGENKPTRKMNHQFTAFVEGIDFKVLPSGKFEKI

SEQ ID NO: 34 - protein, 1688 aa, Ignavibacterium album JCM 16511
MEFKKVLGLDIGTNSIGCALLSLPKSIQDYGKGGRLEWLTSRVIPLDADYMKAFIDGKNGLPQVITPAGKRRQKRGSRRLKHRYKLRRSRLIRVFKTLNWLPEDFPLDNPKRIKETISTEGKFSFRISDYVPISDESYREFYREFGYPENEIEQVIEEINFRRKTKGKNKNPMIKLLPEDWVVYYLRKKALIKPTTKEELIRIIYLFNQRRGFKSSRKDLTETAILDYDEFAKRLAEKEKYSAENYETKFVSITKVKEVVELKTDGRKGKKRFKVILEDSRIEPYEIERKEKPDWEGKEYTFLVTQKLEKGKFKQNKPDLPKEEDWALCTTALDNRMGSKHPGEFFFDELLKAFKEKRGYKIRQYPVNRWRYKKELEFIWTKQCQLNPELNNLNINKEILRKLATVLYPSQSKFFGPKIKEFENSDVLHIISEDIIYYQRDLKSQKSLISECRYEKRKGIDGEIYGLKCIPKSSPLYQEFRIWQDIHNIKVIRKESEVNGKKKINIDETQLYINENIKEKLFELFNSKDSLSEKDILELISLNIINSGIKISKKEEETTHRINLFANRKELKGNETKSRYRKVFKKLGFDGEYILNHPSKLNRLWHSDYSNDYADKEKTEKSILSSLGWKNRNGKWEKSKNYDVFNLPLEVAKAIANLPPLKKEYGSYSALAIRKMLVVMRDGKYWQHPDQIAKDQENTSLMLFDKNLIQLTNNQRKVLNKYLLTLAEVQKRSTLIKQKLNEIEHNPYKLELVSDQDLEKQVLKSFLEKKNESDYLKGLKTYQAGYLIYGKHSEKDVPIVNSPDELGEYIRKKLPNNSLRNPIVEQVIRETIFIVRDVWKSFGIIDEIHIELGRELKNNSEERKKTSESQEKNFQEKERARKLLKELLNSSNFEHYDENGNKIFSSFTVNPNPDSPLDIEKFRIWKNQSGLTDEELNKKLKDEKIPTEIEVKKYILWLTQKCRSPYTGKIIPLSKLFDSNVYEIEHIIPRSKMKNDSTNNLVICELGVNKAKGDRLAANFISESNGKCKFGEVEYTLLKYGDYLQYCKDTFKYQKAKYKNLLATEPPEDFIERQINDTRYIGRKLAELLTPVVKDSKNIIFTIGSITSELKITWGLNGVWKDILRPRFKRLESIINKKLIFQDEDDPNKYHFDLSINPQLDKEGLKRLDHRHHALDATIIAATTREHVRYLNSLNAADNDEEKREYFLSLCNHKIRDFKLPWENFTSEVKSKLLSCVVSYKESKPILSDPFNKYLKWEYKNGKWQKVFAIQIKNDRWKAVRRSMFKEPIGTVWIKKIKEVSLKEAIKIQAIWEEVKNDPVRKKKEKYIYDDYAQKVIAKIVQELGLSSSMRKQDDEKLNKFINEAKVSAGVNKNLNTTNKTIYNLEGRFYEKIKVAEYVLYKAKRMPLNKKEYIEKLSLQKMFNDLPNFILEKSILDNYPEILKELESDNKYIIEPHKKNNPVNRLLLEHILEYHNNPKEAFSTEGLEKLNKKAINKIGKPIKYITRLDGDINEEEIFRGAVFETDKGSNVYFVMYENNQTKDREFLKPNPSISVLKAIEHKNKIDFFAPNRLGFSRIILSPGDLVYVPTNDQYVLIKDNSSNETIINWDDNEFISNRIYQVKKFTGNSCYFLKNDIASLILSYSASNGVGEFGSQNISEYSVDDPPIRIKDVCIKIRVDRLGNVRPL

SEQ ID NO: 35 - protein, 1415 aa, Bergeyella zoohelcum ATCC 43767
MKHILGLDLGTNSIGWALIERNIEEKYGKIIGMGSRIVPMGAELSKFEQGQAQTKNADRRTNRGARRLNKRYKQRRNKLIYILQKLDMLPSQIKLKEDFSDPNKIDKITILPISKKQEQLTAFDLVSLRVKALTEKVGLEDLGKIIYKYNQLRGYAGGSLEPEKEDIFDEEQSKDKKNKSFIAFSKIVFLGEPQEEIFKNKKLNRRAIIVETEEGNFEGSTFLENIKVGDSLELLINISASKSGDTITIKLPNKTNWRKKMENIENQLKEKSKEMGREFYISEFLLELLKENRWAKIRNNTILRARYESEFEAIWNEQVKHYPFLENLDKKTLIEIVSFIFPGEKESQKKYRELGLEKGLKYIIKNQVVFYQRELKDQSHLISDCRYEPNEKAIAKSHPVFQEYKVWEQINKLIVNTKIEAGTNRKGEKKYKYIDRPIPTALKEWIFEELQNKKEITFSAIFKKLKAEFDLREGIDFLNGMSPKDKLKGNETKLQLQKSLGELWDVLGLDSINRQIELWNILYNEKGNEYDLTSDRTSKVLEFINKYGNNIVDDNAEETAIRISKIKFARAYSSLSLKAVERILPLVRAGKYFNNDFSQQLQSKILKLLNENVEDPFAKAAQTYLDNNQSVLSEGGVGNSIATILVYDKHTAKEYSHDELYKSYKEINLLKQGDLRNPLVEQIINEALVLIRDIWKNYGIKPNEIRVELARDLKNSAKERATIHKRNKDNQTINNKIKETLVKNKKELSLANIEKVKLWEAQRHLSPYTGQPIPLSDLFDKEKYDVDHIIPISRYFDDSFTNKVISEKSVNQEKANRTAMEYFEVGSLKYSIFTKEQFIAHVNEYFSGVKRKNLLATSIPEDPVQRQIKDTQYIAIRVKEELNKIVGNENVKTTTGSITDYLRNHWGLTDKFKLLLKERYEALLESEKFLEAEYDNYKKDFDSRKKEYEEKEVLFEEQELTREEFIKEYKENYIRYKKNKLIIKGWSKRIDHRHHAIDALIVACTEPAHIKRLNDLNKVLQDWLVEHKSEFMPNFEGSNSELLEEILSLPENERTEIFTQIEKFRAIEMPWKGFPEQVEQKLKEIIISHKPKDKLLLQYNKAGDRQIKLRGQLHEGTLYGISQGKEAYRIPLTKFGGSKFATEKNIQKIVSPFLSGFIANHLKEYNNKKEEAFSAEGIMDLNNKLAQYRNEKGELKPHTPISTVKIYYKDPSKNKKKKDEEDLSLQKLDREKAFNEKLYVKTGDNYLFAVLEGEIKTKKTSQIKRLYDIISFFDATNFLKEEFRNAPDKKTFDKDLLFRQYFEERNKAKLLFTLKQGDFVYLPNENEEVILDKESPLYNQYWGDLKERGKNIYVVQKFSKKQIYFIKHTIADIIKKDVEFGSQNCYETVEGRSIKENCFKLEIDRLGNIVKVIKR

SEQ ID NO: 36 - protein, 1166 aa, Nitrobacter hamburgensis X14
MHVEIDFPHFSRGDSHLAMNKNEILRGSSVLYRLGLDLGSNSLGWFVTHLEKRGDRHEPVALGPGGVRIFPDGRDPQSGTSNAVDRRMARGARKRRDRFVERRKELIAALIKYNLLPDDARERRALEVLDPYALRKTALTDTLPAHHVGRALFHLNQRRGFQSNRKTDSKQSEDGAIKQAASRLATDKGNETLGVFFADMHLRKSYEDRQTAIRAELVRLGKDHLTGNARKKIWAKVRKRLFGDEVLPRADAPHGVRARATITGTKASYDYYPTRDMLRDEFNAIWAGQSAHHATITDEARTEIEHIIFYQRPLKPAIVGKCTLDPATRPFKEDPEGYRAPWSHPLAQRFRILSEARNLEIRDTGKGSRRLTKEQSDLVVAALLANREVKFDKLRTLLKLPAEARFNLESDRRAALDGDQTAARLSDKKGFNKAWRGFPPERQIAIVARLEETEDENELIAWLEKECALDGAAAARVANTTLPDGHCRLGLRAIKKIVPIMQDGLDEDGVAGAGYHIAAKRAGYDHAKLPTGEQLGRLPYYGQWLQDAVVGSGDARDQKEKQYGQFPNPTVHIGLGQLRRVVNDLIDKYGPPTEISIEFTRALKLSEQQKAERQREQRRNQDKNKARAEELAKFGRPANPRNLLKMRLWEELAHDPLDRKCVYTGEQISIERLLSDEVDIDHILPVAMTLDDSPANKIICMRYANRHKRKQTPSEAFGSSPTLQGHRYNWDDIAARATGLPRNKRWRFDANAREEFDKRGGFLARQLNETGWLARLAKQYLGAVTDPNQIWVVPGRLTSMLRGKWGLNGLLPSDNYAGVQDKAEEFLASTDDMEFSGVKNRADHRHHAIDGLVTALTDRSLLWKMANAYDEEHEKFVIEPPWPTMRDDLKAALEKMVVSHKPDHGIEGKLHEDSAYGFVKPLDATGLKEEEAGNLVYRKAIESLNENEVDRIRDIQLRTIVRDHVNVEKTKGVALADALRQLQAPSDDYPQFKHGLRHVRILKKEKGDYLVPIANRASGVAYKAYSAGENFCVEVFETAGGKWDGEAVRRFDANKKNAGPKIAHAPQWRDANEGAKLVMRIHKGDLIRLDHEGRARIMVVHRLDAAAGRFKLADHNETGNLDKRHATNNDIDPFRWLMASYNTLKKLAAVPVRVDELGRVWRVMPN

SEQ ID NO: 37 - protein, 1498 aa, Odoribacter laneus YIT 12061
METTLGIDLGTNSIGLALVDQEEHQILYSGVRIFPEGINKDTIGLGEKEESRNATRRAKRQMRRQYFRKKLRKAKLLELLIAYDMCPLKPEDVRRWKNWDKQQKSTVRQFPDTPAFREWLKQNPYELRKQAVTEDVTRPELGRILYQMIQRRGFLSSRKGKEEGKIFTGKDRMVGIDETRKNLQKQTLGAYLYDIAPKNGEKYRFRTERVRARYTLRDMYIREFEIIWQRQAGHLGLAHEQATRKKNIFLEGSATNVRNSKLITHLQAKYGRGHVLIEDTRITVTFQLPLKEVLGGKIEIEEEQLKFKSNESVLFWQRPLRSQKSLLSKCVFEGRNFYDPVHQKWIIAGPTPAPLSHPEFEEFRAYQFINNIIYGKNEHLTAIQREAVFELMCTESKDFNFEKIPKHLKLFEKFNFDDTTKVPACTTISQLRKLFPHPVWEEKREEIWHCFYFYDDNTLLFEKLQKDYALQTNDLEKIKKIRLSESYGNVSLKAIRRINPYLKKGYAYSTAVLLGGIRNSFGKRFEYFKEYEPEIEKAVCRILKEKNAEGEVIRKIKDYLVHNRFGFAKNDRAFQKLYHHSQAITTQAQKERLPETGNLRNPIVQQGLNELRRTVNKLLATCREKYGPSFKFDHIHVEMGRELRSSKTEREKQSRQIRENEKKNEAAKVKLAEYGLKAYRDNIQKYLLYKEIEEKGGTVCCPYTGKTLNISHTLGSDNSVQIEHIIPYSISLDDSLANKTLCDATFNREKGELTPYDFYQKDPSPEKWGASSWEEIEDRAFRLLPYAKAQRFIRRKPQESNEFISRQLNDTRYISKKAVEYLSAICSDVKAFPGQLTAELRHLWGLNNILQSAPDITFPLPVSATENHREYYVITNEQNEVIRLFPKQGETPRTEKGELLLTGEVERKVFRCKGMQEFQTDVSDGKYWRRIKLSSSVTWSPLFAPKPISADGQIVLKGRIEKGVFVCNQLKQKLKTGLPDGSYWISLPVISQTFKEGESVNNSKLTSQQVQLFGRVREGIFRCHNYQCPASGADGNFWCTLDTDTAQPAFTPIKNAPPGVGGGQIILTGDVDDKGIFHADDDLHYELPASLPKGKYYGIFTVESCDPTLIPIELSAPKTSKGENLIEGNIWVDEHTGEVRFDPKKNREDQRHHAIDAIVIALSSQSLFQRLSTYNARRENKKRGLDSTEHFPSPWPGFAQDVRQSVVPLLVSYKQNPKTLCKISKTLYKDGKKIHSCGNAVRGQLHKETVYGQRTAPGATEKSYHIRKDIRELKTSKHIGKVVDITIRQMLLKHLQENYHIDITQEFNIPSNAFFKEGVYRIFLPNKHGEPVPIKKIRMKEELGNAERLKDNINQYVNPRNNHHVMIYQDADGNLKEEIVSFWSVIERQNQGQPIYQLPREGRNIVSILQINDTFLIGLKEEEPEVYRNDLSTLSKHLYRVQKLSGMYYTFRHHLASTLNNEREEFRIQSLEAWKRANPVKVQIDEIGRITFLNGPLC

SEQ ID NO: 38 - protein, 1372 aa, Legionella pneumophila str. Paris
MESSQILSPIGIDLGGKFTGVCLSHLEAFAELPNHANTKYSVILIDHNNFQLSQAQRRATRHRVRNKKRNQFVKRVALQLFQHILSRDLNAKEETALCHYLNNRGYTYVDTDLDEYIKDETTINLLKELLPSESEHNFIDWFLQKMQSSEFRKILVSKVEEKKDDKELKNAVKNIKNFITGFEKNSVEGHRHRKVYFENIKSDITKDNQLDSIKKKIPSVCLSNLLGHLSNLQWKNLHRYLAKNPKQFDEQTFGNEFLRMLKNFRHLKGSQESLAVRNLIQQLEQSQDYISILEKTPPEITIPPYEARTNTGMEKDQSLLLNPEKLNNLYPNWRNLIPGIIDAHPFLEKDLEHTKLRDRKRIISPSKQDEKRDSYILQRYLDLNKKIDKFKIKKQLSFLGQGKQLPANLIETQKEMETHFNSSLVSVLIQIASAYNKEREDAAQGIWFDNAFSLCELSNINPPRKQKILPLLVGAILSEDFINNKDKWAKFKIFWNTHKIGRTSLKSKCKEIEEARKNSGNAFKIDYEEALNHPEHSNNKALIKIIQTIPDIIQAIQSHLGHNDSQALIYHNPFSLSQLYTILETKRDGFHKNCVAVTCENYWRSQKTEIDPEISYASRLPADSVRPFDGVLARMMQRLAYEIAMAKWEQIKHIPDNSSLLIPIYLEQNRFEFEESFKKIKGSSSDKTLEQAIEKQNIQWEEKFQRIINASMNICPYKGASIGGQGEIDHIYPRSLSKKHFGVIFNSEVNLIYCSSQGNREKKEEHYLLEHLSPLYLKHQFGTDNVSDIKNFISQNVANIKKYISFHLLTPEQQKAARHALFLDYDDEAFKTITKFLMSQQKARVNGTQKFLGKQIMEFLSTLADSKQLQLEFSIKQITAEEVHDHRELLSKQEPKLVKSRQQSFPSHAIDATLTMSIGLKEFPQFSQELDNSWFINHLMPDEVHLNPVRSKEKYNKPNISSTPLFKDSLYAERFIPVWVKGETFAIGFSEKDLFEIKPSNKEKLFTLLKTYSTKNPGESLQELQAKSKAKWLYFPINKTLALEFLHHYFHKEIVTPDDTTVCHFINSLRYYTKKESITVKILKEPMPVLSVKFESSKKNVLGSFKHTIALPATKDWERLFNHPNFLALKANPAPNPKEFNEFIRKYFLSDNNPNSDIPNNGHNIKPQKHKAVRKVFSLPVIPGNAGTMMRIRRKDNKGQPLYQLQTIDDTPSMGIQINEDRLVKQEVLMDAYKTRNLSTIDGINNSEGQAYATFDNWLTLPVSTFKPEIIKLEMKPHSKTRRYIRITQSLADFIKTIDEALMIKPSDSIDDPLNMPNEIVCKNKLFGNELKPRDGKMKIVSTGKIVTYEFESDSTPQWIQTLYVTQLKKQP

SEQ ID NO: 39 - protein, 1517 aa, Bacteroides sp. 20 3
MKKIVGLDLGTNSIGWALINAYINKEHLYGIEACGSRIIPMDAAILGNFDKGNSISQTADRTSYRGIRRLRERHLLRRERLHRILDLLGFLPKHYSDSLNRYGKFLNDIECKLPWVKDETGSYKFIFQESFKEMLANFTEHHPILIANNKKVPYDWTIYYLRKKALTQKISKEELAWILLNFNQKRGYYQLRGEEEETPNKLVEYYSLKVEKVEDSGERKGKDTWYNVHLENGMIYRRTSNIPLDWEGKTKEFIVTTDLEADGSPKKDKEGNIKRSFRAPKDDDWTLIKKKTEADIDKIKMTVGAYIYDTLLQKPDQKIRGKLVRTIERKYYKNELYQILKTQSEFHEELRDKQLYIACLNELYPNNEPRRNSISTRDFCHLFIEDIIFYQRPLKSKKSLIDNCPYEENRYIDKESGEIKHASIKCIAKSHPLYQEFRLWQFIVNLRIYRKETDVDVTQELLPTEADYVTLFEWLNEKKEIDQKAFFKYPPFGFKKTTSNYRWNYVEDKPYPCNETHAQIIARLGKAHIPKAFLSKEKEETLWHILYSIEDKQEIEKALHSFANKNNLSEEFIEQFKNFPPFKKEYGSYSAKAIKKLLPLMRMGKYWSIENIDNGTRIRINKIIDGEYDENIRERVRQKAINLTDITHFRALPLWLACYLVYDRHSEVKDIVKWKTPKDIDLYLKSFKQHSLRNPIVEQVITETLRTVRDIWQQVGHIDEIHIELGREMKNPADKRARMSQQMIKNENTNLRIKALLTEFLNPEFGIENVRPYSPSQQDLLRIYEEGVLNSILELPEDIGIILGKFNQTDTLKRPTRSEILRYKLWLEQKYRSPYTGEMIPLSKLFTPAYEIEHIIPQSRYFDDSLSNKVICESEINKLKDRSLGYEFIKNHHGEKVELAFDKPVEVLSVEAYEKLVHESYSHNRSKMKKLLMEDIPDQFIERQLNDSRYISKVVKSLLSNIVREENEQEAISKNVIPCTGGITDRLKKDWGINDVWNKIVLPRFIRLNELTESTRFTSINTNNTMIPSMPLELQKGFNKKRIDHRHHAMDAIIIACANRNIVNYLNNVSASKNTKITRRDLQTLLCHKDKTDNNGNYKWVIDKPWETFTQDTLTALQKITVSFKQNLRVINKTTNHYQHYENGKKIVSNQSKGDSWAIRKSMHKETVHGEVNLRMIKTVSFNEALKKPQAIVEMDLKKKILAMLELGYDTKRIKNYFEENKDTWQDINPSKIKVYYFTKETKDRYFAVRKPIDTSFDKKKIKESITDTGIQQIMLRHLETKDNDPTLAFSPDGIDEMNRNILILNKGKKHQPIYKVRVYEKAEKFTVGQKGNKRTKFVEAAKGTNLFFAIYETEEIDKDTKKVIRKRSYSTIPLNVVIERQKQGLSSAPEDENGNLPKYILSPNDLVYVPTQEEINKGEVVMPIDRDRIYKMVDSSGITANFIPASTANLIFALPKATAEIYCNGENCIQNEYGIGSPQSKNQKAITGEMVKEICFPIKVDRLGNIIQVGSCILTN

SEQ ID NO: 40 - protein, 1101 aa, Akkermansia muciniphila ATCC BAA-835
MSRSLTFSFDIGYASIGWAVIASASHDDADPSVCGCGTVLFPKDDCQAFKRREYRRLRRNIRSRRVRIERIGRLLVQAQIITPEMKETSGHPAPFYLASEALKGHRTLAPIELWHVLRWYAHNRGYDNNASWSNSLSEDGGNGEDTERVKHAQDLMDKHGTATMAETICRELKLEEGKADAPMEVSTPAYKNLNTAFPRLIVEKEVRRILELSAPLIPGLTAEIIELIAQHHPLTTEQRGVLLQHGIKLARRYRGSLLFGQLIPRFDNRIISRCPVTWAQVYEAELKKGNSEQSARERAEKLSKVPTANCPEFYEYRMARILCNIRADGEPLSAEIRRELMNQARQEGKLTKASLEKAISSRLGKETETNVSNYFTLHPDSEEALYLNPAVEVLQRSGIGQILSPSVYRIAANRLRRGKSVTPNYLLNLLKSRGESGEALEKKIEKESKKKEADYADTPLKPKYATGRAPYARTVLKKVVEEILDGEDPTRPARGEAHPDGELKAHDGCLYCLLDTDSSVNQHQKERRLDTMTNNHLVRHRMLILDRLLKDLIQDFADGQKDRISRVCVEVGKELTTFSAMDSKKIQRELTLRQKSHTDAVNRLKRKLPGKALSANLIRKCRIAMDMNWTCPFTGATYGDHELENLELEHIVPHSFRQSNALSSLVLTWPGVNRMKGQRTGYDFVEQEQENPVPDKPNLHICSLNNYRELVEKLDDKKGHEDDRRRKKKRKALLMVRGLSHKHQSQNHEAMKEIGMTEGMMTQSSHLMKLACKSIKTSLPDAHIDMIPGAVTAEVRKAWDVFGVFKELCPEAADPDSGKILKENLRSLTHLHHALDACVLGLIPYIIPAHHNGLLRRVLAMRRIPEKLIPQVRPVANQRHYVLNDDGRMMLRDLSASLKENIREQLMEQRVIQHVPADMGGALLKETMQRVLSVDGSGEDAMVSLSKKKDGKKEKNQVKASKLVGVFPEGPSKLKALKAAIEIDGNYGVALDPKPVVIRHIKVFKRIMALKEQNGGKPVRILKKGMLIHLTSSKDPKHAGVWRIESIQDSKGGVKLDLQRAHCAVPKNKTHECNWREVDLISLLKKYQMKRYPTSYTGTPR

SEQ ID NO: 41 - protein, 1424 aa, Prevotella sp. C561
MTQKVLGLDLGTNSIGSAVRNLDLSDDLQWQLEFFSSDIFRSSVNKESNGREYSLAAQRSAHRRSRGLNEVRRRRLWATLNLLIKHGFCPMSSESLMRWCTYDKRKGLFREYPIDDKDFNAWILLDFNGDGRPDYSSPYQLRRELVTRQFDFEQPIERYKLGRALYHIAQHRGFKSSKGETLSQQETNSKPSSTDEIPDVAGAMKASEEKLSKGLSTYMKEHNLLTVGAAFAQLEDEGVRVRNNNDYRAIRSQFQHEIETIFKFQQGLSVESELYERLISEKKNVGTIFYKRPLRSQRGNVGKCTLERSKPRCAIGHPLFEKFRAWTLINNIKVRMSVDTLDEQLPMKLRLDLYNECFLAFVRTEFKFEDIRKYLEKRLGIHFSYNDKTINYKDSTSVAGCPITARFRKMLGEEWESFRVEGQKERQAHSKNNISFHRVSYSIEDIWHFCYDAEEPEAVLAFAQETLRLERKKAEELVRIWSAMPQGYAMLSQKAIRNINKILMLGLKYSDAVILAKVPELVDVSDEELLSIAKDYYLVEAQVNYDKRINSIVNGLIAKYKSVSEEYRFADHNYEYLLDESDEKDIIRQIENSLGARRWSLMDANEQTDILQKVRDRYQDFFRSHERKFVESPKLGESFENYLTKKFPMVEREQWKKLYHPSQITIYRPVSVGKDRSVLRLGNPDIGAIKNPTVLRVLNTLRRRVNQLLDDGVISPDETRVVVETARELNDANRKWALDTYNRIRHDENEKIKKILEEFYPKRDGISTDDIDKARYVIDQREVDYFTGSKTYNKDIKKYKFWLEQGGQCMYTGRTINLSNLFDPNAFDIEHTIPESLSFDSSDMNLTLCDAHYNRFIKKNHIPTDMPNYDKAITIDGKEYPAITSQLQRWVERVERLNRNVEYWKGQARRAQNKDRKDQCMREMHLWKMELEYWKKKLERFTVTEVTDGFKNSQLVDTRVITRHAVLYLKSIFPHVDVQRGDVTAKFRKILGIQSVDEKKDRSLHSHHAIDATTLTIIPVSAKRDRMLELFAKIEEINKMLSFSGSEDRTGLIQELEGLKNKLQMEVKVCRIGHNVSEIGTFINDNIIVNHHIKNQALTPVRRRLRKKGYIVGGVDNPRWQTGDALRGEIHKASYYGAITQFAKDDEGKVLMKEGRPQVNPTIKFVIRRELKYKKSAADSGFASWDDLGKAIVDKELFALMKGQFPAETSFKDACEQGIYMIKKGKNGMPDIKLHHIRHVRCEAPQSGLKIKEQTYKSEKEYKRYFYAAVGDLYAMCCYTNGKIREFRIYSLYDVSCHRKSDIEDIPEFITDKKGNRLMLDYKLRTGDMILLYKDNPAELYDLDNVNLSRRLYKINRFESQSNLVLMTHHLSTSKERGRSLGKTVDYQNLPESIRSSVKSLNFLIMGENRDFVIKNGKIIFNHR

SEQ ID NO: 42 - protein, 1409 aa, Wolinella succinogenes DSM 1740
MLVSPISVDLGGKNTGFFSFTDSLDNSQSGTVIYDESFVLSQVGRRSKRHSKRNNLRNKLVKRLFLLILQEHHGLSIDVLPDEIRGLFNKRGYTYAGFELDEKKKDALESDTLKEFLSEKLQSIDRDSDVEDFLNQIASNAESFKDYKKGFEAVFASATHSPNKKLELKDELKSEYGENAKELLAGLRVTKEILDEFDKQENQGNLPRAKYFEELGEYIATNEKVKSFFDSNSLKLTDMTKLIGNISNYQLKELRRYFNDKEMEKGDIWIPNKLHKITERFVRSWHPKNDADRQRRAELMKDLKSKEIMELLTTTEPVMTIPPYDDMNNRGAVKCQTLRLNEEYLDKHLPNWRDIAKRLNHGKFNDDLADSTVKGYSEDSTLLHRLLDTSKEIDIYELRGKKPNELLVKTLGQSDANRLYGFAQNYYELIRQKVRAGIWVPVKNKDDSLNLEDNSNMLKRCNHNPPHKKNQIHNLVAGILGVKLDEAKFAEFEKELWSAKVGNKKLSAYCKNIEELRKTHGNTFKIDIEELRKKDPAELSKEEKAKLRLTDDVILNEWSQKIANFFDIDDKHRQRFNNLFSMAQLHTVIDTPRSGFSSTCKRCTAENRFRSETAFYNDETGEFHKKATATCQRLPADTQRPFSGKIERYIDKLGYELAKIKAKELEGMEAKEIKVPIILEQNAFEYEESLRKSKTGSNDRVINSKKDRDGKKLAKAKENAEDRLKDKDKRIKAFSSGICPYCGDTIGDDGEIDHILPRSHTLKIYGTVFNPEGNLIYVHQKCNQAKADSIYKLSDIKAGVSAQWIEEQVANIKGYKTFSVLSAEQQKAFRYALFLQNDNEAYKKVVDWLRTDQSARVNGTQKYLAKKIQEKLTKMLPNKHLSFEFILADATEVSELRRQYARQNPLLAKAEKQAPSSHAIDAVMAFVARYQKVFKDGTPPNADEVAKLAMLDSWNPASNEPLTKGLSTNQKIEKMIKSGDYGQKNMREVFGKSIFGENAIGERYKPIVVQEGGYYIGYPATVKKGYELKNCKVVTSKNDIAKLEKIIKNQDLISLKENQYIKIFSINKQTISELSNRYFNMNYKNLVERDKEIVGLLEFIVENCRYYTKKVDVKFAPKYIHETKYPFYDDWRRFDEAWRYLQENQNKTSSKDRFVIDKSSLNEYYQPDKNEYKLDVDTQPIWDDFCRWYFLDRYKTANDKKSIRIKARKTFSLLAESGVQGKVFRAKRKIPTGYAYQALPMDNNVIAGDYANILLEANSKTLSLVPKSGISIEKQLDKKLDVIKKTDVRGLAIDNNSFFNADFDTHGIRLIVENTSVKVGNFPISAIDKSAKRMIFRALFEKEKGKRKKKTTISFKESGPVQDYLKVFLKKIVKIQLRTDGSISNIVVRKNAADFTLSFRSEHIQKLLK

SEQ ID NO: 43 - protein, 1146 aa, Alicyclobacillus hesperidum URH17-3-68
MAYRLGLDIGITSVGWAVVALEKDESGLKPVRIQDLGVRIFDKAEDSKTGASLALPRREARSARRRTRRRRHRLWRVKRLLEQHGILSMEQIEALYAQRTSSPDVYALRVAGLDRCLIAEEIARVLIHIAHRRGFQSNRKSEIKDSDAGKLLKAVQENENLMQSKGYRTVAEMLVSEATKTDAEGKLVHGKKHGYVSNVRNKAGEYRHTVSRQAIVDEVRKIFAAQRALGNDVMSEELEDSYLKILCSQRNFDDGPGGDSPYGHGSVSPDGVRQSIYERMVGSCTFETGEKRAPRSSYSFERFQLLTKVVNLRIYRQQEDGGRYPCELTQTERARVIDCAYEQTKITYGKLRKLLDMKDTESFAGLTYGLNRSRNKTEDTVFVEMKFYHEVRKALQRAGVFIQDLSIETLDQIGWILSVWKSDDNRRKKLSTLGLSDNVIEELLPLNGSKFGHLSLKAIRKILPFLEDGYSYDVACELAGYQFQGKTEYVKQRLLPPLGEGEVTNPVVRRALSQAIKVVNAVIRKHGSPESIHIELARELSKNLDERRKIEKAQKENQKNNEQIKDEIREILGSAHVTGRDIVKYKLFKQQQEFCMYSGEKLDVTRLFEPGYAEVDHIIPYGISFDDSYDNKVLVKTEQNRQKGNRTPLEYLRDKPEQKAKFIALVESIPLSQKKKNHLLMDKRAIDLEQEGFRERNLSDTRYITRALMNHIQAWLLFDETASTRSKRVVCVNGAVTAYMRARWGLTKDRDAGDKHHAADAVVVACIGDSLIQRVTKYDKFKRNALADRNRYVQQVSKSEGITQYVDKETGEVFTWESFDERKFLPNEPLEPWPFFRDELLARLSDDPSKNIRAIGLLTYSETEQIDPIFVSRMPTRKVTGAAHKETIRSPRIVKVDDNKGTEIQVVVSKVALTELKLTKDGEIKDYFRPEDDPRLYNTLRERLVQFGGDAKAAFKEPVYKISKDGSVRTPVRKVKIQEKLTLGVPVHGGRGIAENGGMVRIDVFAKGGKYYFVPIYVADVLKRELPNRLATAHKPYSEWRVVDDSYQFKFSLYPNDAVMIKPSREVDITYKDRKEPVGCRIMYFVSANIASASISLRTHDNSGELEGLGIQGLEVFEKYVVGPLGDTHPVYKERRMPFRVERKMN

SEQ ID NO: 44 - protein, 1442 aa, Caenispirillum salinarum AK4
MPVLSPLSPNAAQGRRRWSLALDIGEGSIGWAVAEVDAEGRVLQLTGTGVTLFPSAWSNENGTYVAHGAADRAVRGQQQRHDSRRRRLAGLARLCAPVLERSPEDLKDLTRTPPKADPRAIFFLRADAARRPLDGPELFRVLHHMAAHRGIRLAELQEVDPPPESDADDAAPAATEDEDGTRRAAADERAFRRLMAEHMHRHGTQPTCGEIMAGRLRETPAGAQPVTRARDGLRVGGGVAVPTRALIEQEFDAIRAIQAPRHPDLPWDSLRRLVLDQAPIAVPPATPCLFLEELRRRGETFQGRTITREAIDRGLTVDPLIQALRIRETVGNLRLHERITEPDGRQRYVPRAMPELGLSHGELTAPERDTLVRALMHDPDGLAAKDGRIPYTRLRKLIGYDNSPVCFAQERDTSGGGITVNPTDPLMARWIDGWVDLPLKARSLYVRDVVARGADSAALARLLAEGAHGVPPVAAAAVPAATAAILESDIMQPGRYSVCPWAAEAILDAWANAPTEGFYDVTRGLFGFAPGEIVLEDLRRARGALLAHLPRTMAAARTPNRAAQQRGPLPAYESVIPSQLITSLRRAHKGRAADWSAADPEERNPFLRTWTGNAATDHILNQVRKTANEVITKYGNRRGWDPLPSRITVELAREAKHGVIRRNEIAKENRENEGRRKKESAALDTFCQDNTVSWQAGGLPKERAALRLRLAQRQEFFCPYCAERPKLRATDLFSPAETEIDHVIERRMGGDGPDNLVLAHKDCNNAKGKKTPHEHAGDLLDSPALAALWQGWRKENADRLKGKGHKARTPREDKDFMDRVGWRFEEDARAKAEENQERRGRRMLHDTARATRLARLYLAAAVMPEDPAEIGAPPVETPPSPEDPTGYTAIYRTISRVQPVNGSVTHMLRQRLLQRDKNRDYQTHHAEDACLLLLAGPAVVQAFNTEAAQHGADAPDDRPVDLMPTSDAYHQQRRARALGRVPLATVDAALADIVMPESDRQDPETGRVHWRLTRAGRGLKRRIDDLTRNCVILSRPRRPSETGTPGALHNATHYGRREITVDGRTDTVVTQRMNARDLVALLDNAKIVPAARLDAAAPGDTILKEICTEIADRHDRVVDPEGTHARRWISARLAALVPAHAEAVARDIAELADLDALADADRTPEQEARRSALRQSPYLGRAISAKKADGRARAREQEILTRALLDPHWGPRGLRHLIMREARAPSLVRIRANKTDAFGRPVPDAAVWVKTDGNAVSQLWRLTSVVTDDGRRIPLPKPIEKRIEISNLEYARLNGLDEGAGVTGNNAPPRPLRQDIDRLTPLWRDHGTAPGGYLGTAVGELEDKARSALRGKAMRQTLTDAGITAEAGWRLDSEGAVCDLEVAKGDTVKKDGKTYKVGVITQGIFGMPVDAAGSAPRTPEDCEKFEEQYGIKPWKAKGIPLA

SEQ ID NO: 45 - protein, 1114 aa, Eubacterium rectale ATCC 33656
MNYTEKEKLFMKYILALDIGIASVGWAILDKESETVIEAGSNIFPEASAADNQLRRDMRGAKRNNRRLKTRINDFIKLWENNNLSIPQFKSTEIVGLKVRAITEEITLDELYLILYSYLKHRGISYLEDALDDTVSGSSAYANGLKLNAKELETHYPCEIQQERLNTIGKYRGQSQIINENGEVLDLSNVFTIGAYRKEIQRVFEIQKKYHPELTDEFCDGYMLIFNRKRKYYEGPGNEKSRTDYGRFTTKLDANGNYITEDNIFEKLIGKCSVYPDELRAAAASYTAQEYNVLNDLNNLTINGRKLEENEKHEIVERIKSSNTINMRKIISDCMGENIDDFAGARIDKSGKEIFHKFEVYNKMRKALLEIGIDISNYSREELDEIGYIMTINTDKEAMMEAFQKSWIDLSDDVKQCLINMRKTNGALFNKWQSFSLKIMNELIPEMYAQPKEQMTLLTEMGVTKGTQEEFAGLKYIPVDVVSEDIFNPVVRRSVRISFKILNAVLKKYKALDTIVIEMPRDRNSEEQKKRINDSQKLNEKEMEYIEKKLAVTYGIKLSPSDFSSQKQLSLKLKLWNEQDGICLYSGKTIDPNDIINNPQLFEIDHIIPRSISFDDARSNKVLVYRSENQKKGNQTPYYYLTHSHSEWSFEQYKATVMNLSKKKEYAISRKKIQNLLYSEDITKMDVLKGFINRNINDTSYASRLVLNTIQNFFMANEADTKVKVIKGSYTHQMRCNLKLDKNRDESYSHHAVDAMLIGYSELGYEAYHKLQGEFIDFETGEILRKDMWDENMSDEVYADYLYGKKWANIRNEVVKAEKNVKYWHYVMRKSNRGLCNQTIRGTREYDGKQYKINKLDIRTKEGIKVFAKLAFSKKDSDRERLLVYLNDRRTFDDLCKIYEDYSDAANPFVQYEKETGDIIRKYSKKHNGPRIDKLKYKDGEVGACIDISHKYGFEKGSKKVILESLVPYRMDVYYKEENHSYYLVGVKQSDIKFEKGRNVIDEEAYARILVNEKMIQPGQSRADLENLGFKFKLSFYKNDIIEYEKDGKIYTERLVSRTMPKQRNYIETKPIDKAKFEKQNLVGLGKTKFIKKYRYDILGNKYSCSEEKFTSFC

SEQ ID NO: 46 - protein, 1314 aa, Mycoplasma synoviae 53
MLRLYCANNLVLNNVQNLWKYLLLLIFDKKIIFLFKIKVILIRRYMENNNKEKIVIGFDLGVASVGWSIVNAETKEVIDLGVRLFSEPEKADYRRAKRTTRRLLRRKKFKREKFHKLILKNAEIFGLQSRNEILNVYKDQSSKYRNILKLKINALKEEIKPSELVWILRDYLQNRGYFYKNEKLTDEFVSNSFPSKKLHEHYEKYGFFRGSVKLDNKLDNKKDKAKEKDEEEESDAKKESEELIFSNKQWINEIVKVFENQSYLTESFKEEYLKLFNYVRPFNKGPGSKNSRTAYGVFSTDIDPETNKFKDYSNIWDKTIGKCSLFEEEIRAPKNLPSALIFNLQNEICTIKNEFTEFKNWWLNAEQKSEILKFVFTELFNWKDKKYSDKKFNKNLQDKIKKYLLNFALENFNLNEEILKNRDLENDTVLGLKGVKYYEKSNATADAALEFSSLKPLYVFIKFLKEKKLDLNYLLGLENTEILYFLDSIYLAISYSSDLKERNEWFKKLLKELYPKIKNNNLEIIENVEDIFEITDQEKFESFSKTHSLSREAFNHIIPLLLSNNEGKNYESLKHSNEELKKRTEKAELKAQQNQKYLKDNFLKEALVPLSVKTSVLQAIKIFNQIIKNFGKKYEISQVVIEMARELTKPNLEKLLNNATNSNIKILKEKLDQTEKFDDFTKKKFIDKIENSVVFRNKLFLWFEQDRKDPYTQLDIKINEIEDETEIDHVIPYSKSADDSWFNKLLVKKSTNQLKKNKTVWEYYQNESDPEAKWNKFVAWAKRIYLVQKSDKESKDNSEKNSIFKNKKPNLKFKNITKKLFDPYKDLGFLARNLNDTRYATKVFRDQLNNYSKHHSKDDENKLFKVVCMNGSITSFLRKSMWRKNEEQVYRFNFWKKDRDQFFHHAVDASIIAIFSLLTKTLYNKLRVYESYDVQRREDGVYLINKETGEVKKADKDYWKDQHNFLKIRENAIEIKNVLNNVDFQNQVRYSRKANTKLNTQLFNETLYGVKEFENNFYKLEKVNLFSRKDLRKFILEDLNEESEKNKKNENGSRKRILTEKYIVDEILQILENEEFKDSKSDINALNKYMDSLPSKFSEFFSQDFINKCKKENSLILTFDAIKHNDPKKVIKIKNLKFFREDATLKNKQAVHKDSKNQIKSFYESYKCVGFIWLKNKNDLEESIFVPINSRVIHFGDKDKDIFDFDSYNKEKLLNEINLKRPENKKFNSINEIEFVKFVKPGALLLNFENQQIYYISTLESSSLRAKIKLLNKMDKGKAVSMKKITNPDEYKIIEHVNPLGINLNWTKKLENNN

SEQ ID NO: 47 - protein, 1197 aa, Porphyromonas sp. oral taxon 279 str. F0450
MLMSKHVLGLDLGVGSIGWCLIALDAQGDPAEILGMGSRVVPLNNATKAIEAFNAGAAFTASQERTARRTMRRGFARYQLRRYRLRRELEKVGMLPDAALIQLPLLELWELRERAATAGRRLTLPELGRVLCHINQKRGYRHVKSDAAAIVGDEGEKKKDSNSAYLAGIRANDEKLQAEHKTVGQYFAEQLRQNQSESPTGGISYRIKDQIFSRQCYIDEYDQIMAVQRVHYPDILTDEFIRMLRDEVIFMQRPLKSCKHLVSLCEFEKQERVMRVQQDDGKGGWQLVERRVKFGPKVAPKSSPLFQLCCIYEAVNNIRLTRPNGSPCDITPEERAKIVAHLQSSASLSFAALKKLLKEKALIADQLTSKSGLKGNSTRVALASALQPYPQYHHLLDMELETRMMTVQLTDEETGEVTEREVAVVTDSYVRKPLYRLWHILYSIEEREAMRRALITQLGMKEEDLDGGLLDQLYRLDFVKPGYGNKSAKFICKLLPQLQQGLGYSEACAAVGYRHSNSPTSEEITERTLLEKIPLLQRNELRQPLVEKILNQMINLVNALKAEYGIDEVRVELARELKMSREERERMARNNKDREERNKGVAAKIRECGLYPTKPRIQKYMLWKEAGRQCLYCGRSIEEEQCLREGGMEVEHIIPKSVLYDDSYGNKTCACRRCNKEKGNRTALEYIRAKGREAEYMKRINDLLKEKKISYSKHQRLRWLKEDIPSDFLERQLRLTQYISRQAMAILQQGIRRVSASEGGVTARLRSLWGYGKILHTLNLDRYDSMGETERVSREGEATEELHITNWSKRMDHRHHAIDALVVACTRQSYIQRLNRLSSEFGREDKKKEDQEAQEQQATETGRLSNLERWLTQRPHFSVRTVSDKVAEILISYRPGQRVVTRGRNIYRKKMADGREVSCVQRGVLVPRGELMEASFYGKILSQGRVRIVKRYPLHDLKGEVVDPHLRELITTYNQELKSREKGAPIPPLCLDKDKKQEVRSVRCYAKTLSLDKAIPMCFDEKGEPTAFVKSASNHHLALYRTPKGKLVESIVTFWDAVDRARYGIPLVITHPREVMEQVLQRGDIPEQVLSLLPPSDWVFVDSLQQDEMVVIGLSDEELQRALEAQNYRKISEHLYRVQKMSSSYYVFRYHLETSVADDKNTSGRIPKFHRVQSLKAYEERNIRKVRVDLLGRISLL

SEQ ID NO: 48 - protein, 1121 aa, Streptococcus thermophilus LMD-9
MSDLVLGLDIGIGSVGVGILNKVTGEIIHKNSRIFPAAQAENNLVRRTNRQGRRLARRKKHRRVRLNRLFEESGLITDFTKISINLNPYQLRVKGLTDELSNEELFIALKNMVKHRGISYLDDASDDGNSSVGDYAQIVKENSKQLETKTPGQIQLERYQTYGQLRGDFTVEKDGKKHRLINVFPTSAYRSEALRILQTQQEFNPQITDEFINRYLEILTGKRKYYHGPGNEKSRTDYGRYRTSGETLDNIFGILIGKCTFYPDEFRAAKASYTAQEFNLLNDLNNLTVPTETKKLSKEQKNQIINYVKNEKAMGPAKLFKYIAKLLSCDVADIKGYRIDKSGKAEIHTFEAYRKMKTLETLDIEQMDRETLDKLAYVLTLNTEREGIQEALEHEFADGSFSQKQVDELVQFRKANSSIFGKGWHNFSVKLMMELIPELYETSEEQMTILTRLGKQKTTSSSNKTKYIDEKLLTEEIYNPVVAKSVRQAIKIVNAAIKEYGDFDNIVIEMARETNEDDEKKAIQKIQKANKDEKDAAMLKAANQYNGKAELPHSVFHGHKQLATKIRLWHQQGERCLYTGKTISIHDLINNSNQFEVDHILPLSITFDDSLANKVLVYATANQEKGQRTPYQALDSMDDAWSFRELKAFVRESKTLSNKKKEYLLTEEDISKFDVRKKFIERNLVDTRYASRVVLNALQEHFRAHKIDTKVSVVRGQFTSQLRRHWGIEKTRDTYHHHAVDALIIAASSQLNLWKKQKNTLVSYSEDQLLDIETGELISDDEYKESVFKAPYQHFVDTLKSKEFEDSILFSYQVDSKFNRKISDATIYATRQAKVGKDKADETYVLGKIKDIYTQDGYDAFMKIYKKDKSKFLMYRHDPQTFEKVIEPILENYPNKQINEKGKEVPCNPFLKYKEEHGYIRKYSKKGNGPEIKSLKYYDSKLGNHIDITPKDSNNKVVLQSVSPWRADVYFNKTTGKYEILGLKYADLQFEKGTGTYKISQEKYNDIKKKEGVDSDSEFKFTLYKNDLLLVKDTETKEQQLFRFLSRTMPKQKHYVELKPYDKQKFEGGEALIKVLGNVANSGQCKKGLGKSNISIYKVRTDVLGNQHIIKNEGDKPKLDF

SEQ ID NO: 49 - protein, 1152 aa, Roseburia inulinivorans DSM 16841
MNAEHGKEGLLIMEENFQYRIGLDIGITSVGWAVLQNNSQDEPVRITDLGVRIFDVAENPKNGDALAAPRRDARTTRRRLRRRRHRLERIKFLLQENGLIEMDSFMERYYKGNLPDVYQLRYEGLDRKLKDEELAQVLIHIAKHRGFRSTRKAETKEKEGGAVLKATTENQKIMQEKGYRTVGEMLYLDEAFHTECLWNEKGYVLTPRNRPDDYKHTILRSMLVEEVHAIFAAQRAHGNQKATEGLEEAYVEIMTSQRSFDMGPGLQPDGKPSPYAMEGFGDRVGKCTFEKDEYRAPKATYTAELFVALQKINHTKLIDEFGTGRFFSEEERKTIIGLLLSSKELKYGTIRKKLNIDPSLKFNSLNYSAKKEGETEEERVLDTEKAKFASMFWTYEYSKCLKDRTEEMPVGEKADLFDRIGEILTAYKNDDSRSSRLKELGLSGEEIDGLLDLSPAKYQRVSLKAMRKMQPYLEDGLIYDKACEAAGYDFRALNDGNKKHLLKGEEINAIVNDITNPVVKRSVSQTIKVINAIIQKYGSPQAVNIELAREMSKNFQDRTNLEKEMKKRQQENERAKQQIIELGKQNPTGQDILKYRLWNDQGGYCLYSGKKIPLEELFDGGYDIDHILPYSITFDDSYRNKVLVTAQENRQKGNRTPYEYFGADEKRWEDYEASVRLLVRDYKKQQKLLKKNFTEEERKEFKERNLNDTKYITRVVYNMIRQNLELEPFNHPEKKKQVWAVNGAVTSYLRKRWGLMQKDRSTDRHHAMDAVVIACCTDGMIHKISRYMQGRELAYSRNFKFPDEETGEILNRDNFTREQWDEKFGVKVPLPWNSFRDELDIRLLNEDPKNFLLTHADVQRELDYPGWMYGEEESPIEEGRYINYIRPLFVSRMPNHKVTGSAHDATIRSARDYETRGVVITKVPLTDLKLNKDNEIEGYYDKDSDRLLYQALVRQLLLHGNDGKKAFAEDFHKPKADGTEGPVVRKVKIEKKQTSGVMVRGGTGIAANGEMVRIDVFRENGKYYFVPVYTADVVRKVLPNRAATHTKPYSEWRVMDDANFVFSLYSRDLIHVKSKKDIKTNLVNGGLLLQKEIFAYYTGADIATASIAGFANDSNFKFRGLGIQSLEIFEKCQVDILGNISVVRHENRQEFH

SEQ ID NO: 50 - protein, 1082 aa, Methylosinus trichosporium OB3b
MRVLGLDAGIASLGWALIEIEESNRGELSQGTIIGAGTWMFDAPEEKTQAGAKLKSEQRRTFRGQRRVVRRRRQRMNEVRRILHSHGLLPSSDRDALKQPGLDPWRIRAEALDRLLGPVELAVALGHIARHRGFKSNSKGAKTNDPADDTSKMKRAVNETREKLARFGSAAKMLVEDESFVLRQTPTKNGASEIVRRFRNREGDYSRSLLRDDLAAEMRALFTAQARFQSAIATADLQTAFTKAAFFQRPLQDSEKLVGPCPFEVDEKRAPKRGYSFELFRFLSRLNHVTLRDGKQERTLTRDELALAAADFGAAAKVSFTALRKKLKLPETTVFVGVKADEESKLDVVARSGKAAEGTARLRSVIVDALGELAWGALLCSPEKLDKIAEVISFRSDIGRISEGLAQAGCNAPLVDALTAAASDGRFDPFTGAGHISSKAARNILSGLRQGMTYDKACCAADYDHTASRERGAFDVGGHGREALKRILQEERISRELVGSPTARKALIESIKQVKAIVERYGVPDRIHVELARDVGKSIEEREEITRGIEKRNRQKDKLRGLFEKEVGRPPQDGARGKEELLRFELWSEQMGRCLYTDDYISPSQLVATDDAVQVDHILPWSRFADDSYANKTLCMAKANQDKKGRTPYEWFKAEKTDTEWDAFIVRVEALADMKGFKKRNYKLRNAEEAAAKFRNRNLNDTRWACRLLAEALKQLYPKGEKDKDGKERRRVFSRPGALTDRLRRAWGLQWMKKSTKGDRIPDDRHHALDAIVIAATTESLLQRATREVQEIEDKGLHYDLVKNVTPPWPGFREQAVEAVEKVFVARAERRRARGKAHDATIRHIAVREGEQRVYERRKVAELKLADLDRVKDAERNARLIEKLRNWIEAGSPKDDPPLSPKGDPIFKVRLVTKSKVNIALDTGNPKRPGTVDRGEMARVDVFRKASKKGKYEYYLVPIYPHDIATMKTPPIRAVQAYKPEDEWPEMDSSYEFCWSLVPMTYLQVISSKGEIFEGYYRGMNRSVGAIQLSAHSNSSDVVQGIGARTLTEFKKFNVDRFGRKHEVERELRTWRGETWRGKAYI

SEQ ID NO: 51 - protein, 1156 aa, Ruminococcus albus 8
MGNYYLGLDVGIGSIGWAVINIEKKRIEDFNVRIFKSGEIQEKNRNSRASQQCRRSRGLRRLYRRKSHRKLRLKNYLSIIGLTTSEKIDYYYETADNNVIQLRNKGLSEKLTPEEIAACLIHICNNRGYKDFYEVNVEDIEDPDERNEYKEEHDSIVLISNLMNEGGYCTPAEMICNCREFDEPNSVYRKFHNSAASKNHYLITRHMLVKEVDLILENQSKYYGILDDKTIAKIKDIIFAQRDFEIGPGKNERFRRFTGYLDSIGKCQFFKDQERGSRFTVIADIYAFVNVLSQYTYTNNRGESVFDTSFANDLINSALKNGSMDKRELKAIAKSYHIDISDKNSDTSLTKCFKYIKVVKPLFEKYGYDWDKLIENYTDTDNNVLNRIGIVLSQAQTPKRRREKLKALNIGLDDGLINELTKLKLSGTANVSYKYMQGSIEAFCEGDLYGKYQAKFNKEIPDIDENAKPQKLPPFKNEDDCEFFKNPVVFRSINETRKLINAIIDKYGYPAAVNIETADELNKTFEDRAIDTKRNNDNQKENDRIVKEIIECIKCDEVHARHLIEKYKLWEAQEGKCLYSGETITKEDMLRDKDKLFEVDHIVPYSLILDNTINNKALVYAEENQKKGQRTPLMYMNEAQAADYRVRVNTMFKSKKCSKKKYQYLMLPDLNDQELLGGWRSRNLNDTRYICKYLVNYLRKNLRFDRSYESSDEDDLKIRDHYRVFPVKSRFTSMFRRWWLNEKTWGRYDKAELKKLTYLDHAADAIIIANCRPEYVVLAGEKLKLNKMYHQAGKRITPEYEQSKKACIDNLYKLFRMDRRTAEKLLSGHGRLTPIIPNLSEEVDKRLWDKNIYEQFWKDDKDKKSCEELYRENVASLYKGDPKFASSLSMPVISLKPDHKYRGTITGEEAIRVKEIDGKLIKLKRKSISEITAESINSIYTDDKILIDSLKTIFEQADYKDVGDYLKKTNQHFFTTSSGKRVNKVTVIEKVPSRWLRKEIDDNNFSLLNDSSYYCIELYKDSKGDNNLQGIAMSDIVHDRKTKKLYLKPDFNYPDDYYTHVMYIFPGDYLRIKSTSKKSGEQLKFEGYFISVKNVNENSFRFISDNKPCAKDKRVSITKKDIVIKLAVDLMGKVQGENNGKGISCGEPLSLLKEKN

SEQ ID NO: 52 - protein, 1187 aa, Bifidobacterium longum DJO10A
MLSRQLLGASHLARPVSYSYNVQDNDVHCSYGERCFMRGKRYRIGIDVGLNSVGLAAVEVSDENSPVRLLNAQSVIHDGGVDPQKNKEAITRKNMSGVARRTRRMRRRKRERLHKLDMLLGKFGYPVIEPESLDKPFEEWHVRAELATRYIEDDELRRESISIALRHMARHRGWRNPYRQVDSLISDNPYSKQYGELKEKAKAYNDDATAAEEESTPAQLVVAMLDAGYAEAPRLRWRTGSKKPDAEGYLPVRLMQEDNANELKQIFRVQRVPADEWKPLFRSVFYAVSPKGSAEQRVGQDPLAPEQARALKASLAFQEYRIANVITNLRIKDASAELRKLTVDEKQSIYDQLVSPSSEDITWSDLCDFLGFKRSQLKGVGSLTEDGEERISSRPPRLTSVQRIYESDNKIRKPLVAWWKSASDNEHEAMIRLLSNTVDIDKVREDVAYASAIEFIDGLDDDALTKLDSVDLPSGRAAYSVETLQKLTRQMLTTDDDLHEARKTLFNVTDSWRPPADPIGEPLGNPSVDRVLKNVNRYLMNCQQRWGNPVSVNIEHVRSSFSSVAFARKDKREYEKNNEKRSIFRSSLSEQLRADEQMEKVRESDLRRLEAIQRQNGQCLYCGRTITFRTCEMDHIVPRKGVGSTNTRTNFAAVCAECNRMKSNTPFAIWARSEDAQTRGVSLAEAKKRVTMFTFNPKSYAPREVKAFKQAVIARLQQTEDDAAIDNRSIESVAWMADELHRRIDWYFNAKQYVNSASIDDAEAETMKTTVSVFQGRVTASARRAAGIEGKIHFIGQQSKTRLDRRHHAVDASVIAMMNTAAAQTLMERESLRESQRLIGLMPGERSWKEYPYEGTSRYESFHLWLDNMDVLLELLNDALDNDRIAVMQSQRYVLGNSIAHDATIHPLEKVPLGSAMSADLIRRASTPALWCALTRLPDYDEKEGLPEDSHREIRVHDTRYSADDEMGFFASQAAQIAVQEGSADIGSAIHHARVYRCWKTNAKGVRKYFYGMIRVFQTDLLRACHDDLFTVPLPPQSISMRYGEPRVVQALQSGNAQYLGSLVVGDEIEMDFSSLDVDGQIGEYLQFFSQFSGGNLAWKHWVVDGFFNQTQLRIRPRYLAAEGLAKAFSDDVVPDGVQKIVTKQGWLPPVNTASKTAVRIVRRNAFGEPRLSSAHHMPCSWQWRHE

SEQ ID NO: 53 - protein, 1150 aa, Enterococcus faecalis TX0012
MYSIGLDLGISSVGWSVIDERTGNVIDLGVRLFSAKNSEKNLERRTNRGGRRLIRRKTNRLKDAKKILAAVGFYEDKSLKNSCPYQLRVKGLTEPLSRGEIYKVTLHILKKRGISYLDEVDTEAAKESQDYKEQVRKNAQLLTKYTPGQIQLQRLKENNRVKTGINAQGNYQLNVFKVSAYANELATILKTQQAFYPNELTDDWIALFVQPGIAEEAGLIYRKRPYYHGPGNEANNSPYGRWSDFQKTGEPATNIFDKLIGKDFQGELRASGLSLSAQQYNLLNDLTNLKIDGEVPLSSEQKEYILTELMTKEFTRFGVNDVVKLLGVKKERLSGWRLDKKGKPEIHTLKGYRNWRKIFAEAGIDLATLPTETIDCLAKVLTLNTEREGIENTLAFELPELSESVKLLVLDRYKELSQSISTQSWHRFSLKTLHLLIPELMNATSEQNTLLEQFQLKSDVRKRYSEYKKLPTKDVLAEIYNPTVNKTVSQAFKVIDALLVKYGKEQIRYITIEMPRDDNEEDEKKRIKELHAKNSQRKNDSQSYFMQKSGWSQEKFQTTIQKNRRFLAKLLYYYEQDGICAYTGLPISPELLVSDSTEIDHIIPISISLDDSINNKVLVLSKANQVKGQQTPYDAWMDGSFKKINGKFSNWDDYQKWVESRHFSHKKENNLLETRNIFDSEQVEKFLARNLNDTRYASRLVLNTLQSFFTNQETKVRVVNGSFTHTLRKKWGADLDKTRETHHHHAVDATLCAVTSFVKVSRYHYAVKEETGEKVMREIDFETGEIVNEMSYWEFKKSKKYERKTYQVKWPNFREQLKPVNLHPRIKFSHQVDRKANRKLSDATIYSVREKTEVKTLKSGKQKITTDEYTIGKIKDIYTLDGWEAFKKKQDKLLMKDLDEKTYERLLSIAETTPDFQEVEEKNGKVKRVKRSPFAVYCEENDIPAIQKYAKKNNGPLIRSLKYYDGKLNKHINITKDSQGRPVEKTKNGRKVTLQSLKPYRYDIYQDLETKAYYTVQLYYSDLRFVEGKYGITEKEYMKKVAEQTKGQVVRFCFSLQKNDGLEIEWKDSQRYDVRFYNFQSANSINFKGLEQEMMPAENQFKQKPYNNGAINLNIAKYGKEGKKLRKFNTDILGKKHYLFYEKEPKNIIK

SEQ ID NO: 54 - protein, 1236 aa, Mycoplasma mobile 163K
MYFYKNKENKLNKKVVLGLDLGIASVGWCLTDISQKEDNKFPIILHGVRLFETVDDSDDKLLNETRRKKRGQRRRNRRLFTRKRDFIKYLIDNNIIELEFDKNPKILVRNFIEKYINPFSKNLELKYKSVTNLPIGFHNLRKAAINEKYKLDKSELIVLLYFYLSLRGAFFDNPEDTKSKEMNKNEIEIFDKNESIKNAEFPIDKIIEFYKISGKIRSTINLKFGHQDYLKEIKQVFEKQNIDFMNYEKFAMEEKSFFSRIRNYSEGPGNEKSFSKYGLYANENGNPELIINEKGQKIYTKIFKTLWESKIGKCSYDKKLYRAPKNSFSAKVFDITNKLTDWKHKNEYISERLKRKILLSRFLNKDSKSAVEKILKEENIKFENLSEIAYNKDDNKINLPIINAYHSLTTIFKKHLINFENYLISNENDLSKLMSFYKQQSEKLFVPNEKGSYEINQNNNVLHIFDAISNILNKFSTIQDRIRILEGYFEFSNLKKDVKSSEIYSEIAKLREFSGTSSLSFGAYYKFIPNLISEGSKNYSTISYEEKALQNQKNNFSHSNLFEKTWVEDLIASPTVKRSLRQTMNLLKEIFKYSEKNNLEIEKIVVEVTRSSNNKHERKKIEGINKYRKEKYEELKKVYDLPNENTTLLKKLWLLRQQQGYDAYSLRKIEANDVINKPWNYDIDHIVPRSISFDDSFSNLVIVNKLDNAKKSNDLSAKQFIEKIYGIEKLKEAKENWGNWYLRNANGKAFNDKGKFIKLYTIDNLDEFDNSDFINRNLSDTSYITNALVNHLTFSNSKYKYSVVSVNGKQTSNLRNQIAFVGIKNNKETEREWKRPEGFKSINSNDFLIREEGKNDVKDDVLIKDRSFNGHHAEDAYFITIISQYFRSFKRIERLNVNYRKETRELDDLEKNNIKFKEKASFDNFLLINALDELNEKLNQMRFSRMVITKKNTQLFNETLYSGKYDKGKNTIKKVEKLNLLDNRTDKIKKIEEFFDEDKLKENELTKLHIFNHDKNLYETLKIIWNEVKIEIKNKNLNEKNYFKYFVNKKLQEGKISFNEWVPILDNDFKIIRKIRYIKFSSEEKETDEIIFSQSNFLKIDQRQNFSFHNTLYWVQIWVYKNQKDQYCFISIDARNSKFEKDEIKINYEKLKTQKEKLQIINEEPILKINKGDLFENEEKELFYIVGRDEKPQKLEIKYILGKKIKDQKQIQKPVKKYFPNWKKVNLTYMGEIFKK

SEQ ID NO: 55 - protein, 1105 aa, Actinomyces coleocanis DSM 15436
MDNKNYRIGIDVGLNSIGFCAVEVDQHDTPLGFLNLSVYRHDAGIDPNGKKTNTTRLAMSGVARRTRRLFRKRKRRLAALDRFIEAQGWTLPDHADYKDPYTPWLVRAELAQTPIRDENDLHEKLAIAVRHIARHRGWRSPWVPVRSLHVEQPPSDQYLALKERVEAKTLLQMPEGATPAEMVVALDLSVDVNLRPKNREKTDTRPENKKPGFLGGKLMQSDNANELRKIAKIQGLDDALLRELIELVFAADSPKGASGELVGYDVLPGQHGKRRAEKAHPAFQRYRIASIVSNLRIRHLGSGADERLDVETQKRVFEYLLNAKPTADITWSDVAEEIGVERNLLMGTATQTADGERASAKPPVDVTNVAFATCKIKPLKEWWLNADYEARCVMVSALSHAEKLTEGTAAEVEVAEFLQNLSDEDNEKLDSFSLPIGRAAYSVDSLERLTKRMIENGEDLFEARVNEFGVSEDWRPPAEPIGARVGNPAVDRVLKAVNRYLMAAEAEWGAPLSVNIEHVREGFISKRQAVEIDRENQKRYQRNQAVRSQIADHINATSGVRGSDVTRYLAIQRQNGECLYCGTAITFVNSEMDHIVPRAGLGSTNTRDNLVATCERCNKSKSNKPFAVWAAECGIPGVSVAEALKRVDFWIADGFASSKEHRELQKGVKDRLKRKVSDPEIDNRSMESVAWMARELAHRVQYYFDEKHTGTKVRVFRGSLTSAARKASGFESRVNFIGGNGKTRLDRRHHAMDAATVAMLRNSVAKTLVLRGNIRASERAIGAAETWKSFRGENVADRQIFESWSENMRVLVEKFNLALYNDEVSIFSSLRLQLGNGKAHDDTITKLQMHKVGDAWSLTEIDRASTPALWCALTRQPDFTWKDGLPANEDRTIIVNGTHYGPLDKVGIFGKAAASLLVRGGSVDIGSAIHHARIYRIAGKKPTYGMVRVFAPDLLRYRNEDLFNVELPPQSVSMRYAEPKVREAIREGKAEYLGWLVVGDELLLDLSSETSGQIAELQQDFPGTTHWTVAGFFSPSRLRLRPVYLAQEGLGEDVSEGSKSIIAGQGWRPAVNKVFGSAMPEVIRRDGLGRKRRFSYSGLPVSWQG

SEQ ID NO: 56 - protein, 1079 aa, Dinoroseobacter shibae DFL 12
MRLGLDIGTSSIGWWLYETDGAGSDARITGVVDGGVRIFSDGRDPKSGASLAVDRRAARAMRRRRDRYLRRRATLMKVLAETGLMPADPAEAKALEALDPFALRAAGLDEPLPLPHLGRALFHLNQRRGFKSNRKTDRGDNESGKIKDATARLDMEMMANGARTYGEFLHKRRQKATDPRHVPSVRTRLSIANRGGPDGKEEAGYDFYPDRRHLEEEFHKLWAAQGAHHPELTETLRDLLFEKIFFQRPLKEPEVGLCLFSGHHGVPPKDPRLPKAHPLTQRRVLYETVNQLRVTADGREARPLTREERDQVIHALDNKKPTKSLSSMVLKLPALAKVLKLRDGERFTLETGVRDAIACDPLRASPAHPDRFGPRWSILDADAQWEVISRIRRVQSDAEHAALVDWLTEAHGLDRAHAEATAHAPLPDGYGRLGLTATTRILYQLTADVVTYADAVKACGWHHSDGRTGECFDRLPYYGEVLERHVIPGSYHPDDDDITRFGRITNPTVHIGLNQLRRLVNRIIETHGKPHQIVVELARDLKKSEEQKRADIKRIRDTTEAAKKRSEKLEELEIEDNGRNRMLLRLWEDLNPDDAMRRFCPYTGTRISAAMIFDGSCDVDHILPYSRTLDDSFPNRTLCLREANRQKRNQTPWQAWGDTPHWHAIAANLKNLPENKRWRFAPDAMTRFEGENGFLDRALKDTQYLARISRSYLDTLFTKGGHVWVVPGRFTEMLRRHWGLNSLLSDAGRGAVKAKNRTDHRHHAIDAAVIAATDPGLLNRISRAAGQGEAAGQSAELIARDTPPPWEGFRDDLRVRLDRIIVSHRADHGRIDHAARKQGRDSTAGQLHQETAYSIVDDIHVASRTDLLSLKPAQLLDEPGRSGQVRDPQLRKALRVATGGKTGKDFENALRYFASKPGPYQAIRRVRIIKPLQAQARVPVPAQDPIKAYQGGSNHLFEIWRLPDGEIEAQVITSFEAHTLEGEKRPHPAAKRLLRVHKGDMVALERDGRRVVGHVQKMDIANGLFIVPHNEANADTRNNDKSDPFKWIQIGARPAIASGIRRVSVDEIGRLRDGGTRPI

SEQ ID NO: 57 - protein, 1181 aa, Actinomyces sp. oral taxon 180 str. F0310
MLHCIAVIRVPPSEEPGFFETHADSCALCHHGCMTYAANDKAIRYRVGIDVGLRSIGFCAVEVDDEDHPIRILNSVVHVHDAGTGGPGETESLRKRSGVAARARRRGRAEKQRLKKLDVLLEELGWGVSSNELLDSHAPWHIRKRLVSEYIEDETERRQCLSVAMAHIARHRGWRNSFSKVDTLLLEQAPSDRMQGLKERVEDRTGLQFSEEVTQGELVATLLEHDGDVTIRGFVRKGGKATKVHGVLEGKYMQSDLVAELRQICRTQRVSETTFEKLVLSIFHSKEPAPSAARQRERVGLDELQLALDPAAKQPRAERAHPAFQKFKVVATLANMRIREQSAGERSLTSEELNRVARYLLNHTESESPTWDDVARKLEVPRHRLRGSSRASLETGGGLTYPPVDDTTVRVMSAEVDWLADWWDCANDESRGHMIDAISNGCGSEPDDVEDEEVNELISSATAEDMLKLELLAKKLPSGRVAYSLKTLREVTAAILETGDDLSQAITRLYGVDPGWVPTPAPIEAPVGNPSVDRVLKQVARWLKFASKRWGVPQTVNIEHTREGLKSASLLEEERERWERFEARREIRQKEMYKRLGISGPFRRSDQVRYEILDLQDCACLYCGNEINFQTFEVDHIIPRVDASSDSRRTNLAAVCHSCNSAKGGLAFGQWVKRGDCPSGVSLENAIKRVRSWSKDRLGLTEKAMGKRKSEVISRLKTEMPYEEFDGRSMESVAWMAIELKKRIEGYFNSDRPEGCAAVQVNAYSGRLTACARRAAHVDKRVRLIRLKGDDGHHKNRFDRRNHAMDALVIALMTPAIARTIAVREDRREAQQLTRAFESWKNFLGSEERMQDRWESWIGDVEYACDRLNELIDADKIPVTENLRLRNSGKLHADQPESLKKARRGSKRPRPQRYVLGDALPADVINRVTDPGLWTALVRAPGFDSQLGLPADLNRGLKLRGKRISADFPIDYFPTDSPALAVQGGYVGLEFHHARLYRIIGPKEKVKYALLRVCAIDLCGIDCDDLFEVELKPSSISMRTADAKLKEAMGNGSAKQIGWLVLGDEIQIDPTKFPKQSIGKFLKECGPVSSWRVSALDTPSKITLKPRLLSNEPLLKTSRVGGHESDLVVAECVEKIMKKTGWVVEINALCQSGLIRVIRRNALGEVRTSPKSGLPISLNLR

SEQ ID NO: 58 - protein, 1113 aa, Alcanivorax sp. W11-5
MRYRVGLDLGTASVGAAVFSMDEQGNPMELIWHYERLFSEPLVPDMGQLKPKKAARRLARQQRRQIDRRASRLRRIAIVSRRLGIAPGRNDSGVHGNDVPTLRAMAVNERIELGQLRAVLLRMGKKRGYGGTFKAVRKVGEAGEVASGASRLEEEMVALASVQNKDSVTVGEYLAARVEHGLPSKLKVAANNEYYAPEYALFRQYLGLPAIKGRPDCLPNMYALRHQIEHEFERIWATQSQFHDVMKDHGVKEEIRNAIFFQRPLKSPADKVGRCSLQTNLPRAPRAQIAAQNFRIEKQMADLRWGMGRRAEMLNDHQKAVIRELLNQQKELSFRKIYKELERAGCPGPEGKGLNMDRAALGGRDDLSGNTTLAAWRKLGLEDRWQELDEVTQIQVINFLADLGSPEQLDTDDWSCRFMGKNGRPRNFSDEFVAFMNELRMTDGFDRLSKMGFEGGRSSYSIKALKALTEWMIAPHWRETPETHRVDEEAAIRECYPESLATPAQGGRQSKLEPPPLTGNEVVDVALRQVRHTINMMIDDLGSVPAQIVVEMAREMKGGVTRRNDIEKQNKRFASERKKAAQSIEENGKTPTPARILRYQLWIEQGHQCPYCESNISLEQALSGAYTNFEHILPRTLTQIGRKRSELVLAHRECNDEKGNRTPYQAFGHDDRRWRIVEQRANALPKKSSRKTRLLLLKDFEGEALTDESIDEFADRQLHESSWLAKVTTQWLSSLGSDVYVSRGSLTAELRRRWGLDTVIPQVRFESGMPVVDEEGAEITPEEFEKFRLQWEGHRVTREMRTDRRPDKRIDHRHHLVDAIVTALTSRSLYQQYAKAWKVADEKQRHGRVDVKVELPMPILTIRDIALEAVRSVRISHKPDRYPDGRFFEATAYGIAQRLDERSGEKVDWLVSRKSLTDLAPEKKSIDVDKVRANISRIVGEAIRLHISNIFEKRVSKGMTPQQALREPIEFQGNILRKVRCFYSKADDCVRIEHSSRRGHHYKMLLNDGFAYMEVPCKEGILYGVPNLVRPSEAVGIKRAPESGDFIRFYKGDTVKNIKTGRVYTIKQILGDGGGKLILTPVTETKPADLLSAKWGRLKVGGRNIHLLRLCAE

SEQ ID NO: 59 - protein, 1052 aa, Aminomonas paucivorans DSM 12260
MIGEHVRGGCLFDDHWTPNWGAFRLPNTVRTFTKAENPKDGSSLAEPRRQARGLRRRLRRKTQRLEDLRRLLAKEGVLSLSDLETLFRETPAKDPYQLRAEGLDRPLSFPEWVRVLYHITKHRGFQSNRRNPVEDGQERSRQEEEGKLLSGVGENERLLREGGYRTAGEMLARDPKFQDHRRNRAGDYSHTLSRSLLLEEARRLFQSQRTLGNPHASSNLEEAFLHLVAFQNPFASGEDIRNKAGHCSLEPDQIRAPRRSASAETFMLLQKTGNLRLIHRRTGEERPLTDKEREQIHLLAWKQEKVTHKTLRRHLEIPEEWLFTGLPYHRSGDKAEEKLFVHLAGIHEIRKALDKGPDPAVWDTLRSRRDLLDSIADTLTFYKNEDEILPRLESLGLSPENARALAPLSFSGTAHLSLSALGKLLPHLEEGKSYTQARADAGYAAPPPDRHPKLPPLEEADWRNPVVFRALTQTRKVVNALVRRYGPPWCIHLETARELSQPAKVRRRIETEQQANEKKKQQAEREFLDIVGTAPGPGDLLKMRLWREQGGFCPYCEEYLNPTRLAEPGYAEMDHILPYSRSLDNGWHNRVLVHGKDNRDKGNRTPFEAFGGDTARWDRLVAWVQASHLSAPKKRNLLREDFGEEAERELKDRNLTDTRFITKTAATLLRDRLTFHPEAPKDPVMTLNGRLTAFLRKQWGLHKNRKNGDLHHALDAAVLAVASRSFVYRLSSHNAAWGELPRGREAENGFSLPYPAFRSEVLARLCPTREEILLRLDQGGVGYDEAFRNGLRPVFVSRAPSRRLRGKAHMETLRSPKWKDHPEGPRTASRIPLKDLNLEKLERMVGKDRDRKLYEALRERLAAFGGNGKKAFVAPFRKPCRSGEGPLVRSLRIFDSGYSGVELRDGGEVYAVADHESMVRVDVYAKKNRFYLVPVYVADVARGIVKNRAIVAHKSEEEWDLVDGSFDFRFSLFPGDLVEIEKKDGAYLGYYKSCHRGDGRLLLDRHDRMPRESDCGTFYVSTRKDVLSMSKYQVDPLGEIRLVGSEKPPFVL

SEQ ID NO: 60 - protein, 1233 aa, Mycoplasma canis PG 14
MEKKRKVTLGFDLGIASVGWAIVDSETNQVYKLGSRLFDAPDTNLERRTQRGTRRLLRRRKYRNQKFYNLVKRTEVFGLSSREAIENRFRELSIKYPNIIELKTKALSQEVCPDEIAWILHDYLKNRGYFYDEKETKEDFDQQTVESMPSYKLNEFYKKYGYFKGALSQPTESEMKDNKDLKEAFFFDFSNKEWLKEINYFFNVQKNILSETFIEEFKKIFSFTRDISKGPGSDNMPSPYGIFGEFGDNGQGGRYEHIWDKNIGKCSIFTNEQRAPKYLPSALIFNFLNELANIRLYSTDKKNIQPLWKLSSVDKLNILLNLFNLPISEKKKKLTSTNINDIVKKESIKSIMISVEDIDMIKDEWAGKEPNVYGVGLSGLNIEESAKENKFKFQDLKILNVLINLLDNVGIKFEFKDRNDIIKNLELLDNLYLFLIYQKESNNKDSSIDLFIAKNESLNIENLKLKLKEFLLGAGNEFENHNSKTHSLSKKAIDEILPKLLDNNEGWNLEAIKNYDEEIKSQIEDNSSLMAKQDKKYLNDNFLKDAILPPNVKVTFQQAILIFNKIIQKFSKDFEIDKVVIELAREMTQDQENDALKGIAKAQKSKKSLVEERLEANNIDKSVFNDKYEKLIYKIFLWISQDFKDPYTGAQISVNEIVNNKVEIDHIIPYSLCFDDSSANKVLVHKQSNQEKSNSLPYEYIKQGHSGWNWDEFTKYVKRVFVNNVDSILSKKERLKKSENLLTASYDGYDKLGFLARNLNDTRYATILFRDQLNNYAEHHLIDNKKMFKVIAMNGAVTSFIRKNMSYDNKLRLKDRSDFSHHAYDAAIIALFSNKTKTLYNLIDPSLNGIISKRSEGYWVIEDRYTGEIKELKKEDWTSIKNNVQARKIAKEIEEYLIDLDDEVFFSRKTKRKTNRQLYNETIYGIATKTDEDGITNYYKKEKFSILDDKDIYLRLLREREKFVINQSNPEVIDQIIEIIESYGKENNIPSRDEAINIKYTKNKINYNLYLKQYMRSLTKSLDQFSEEFINQMIANKTFVLYNPTKNTTRKIKFLRLVNDVKINDIRKNQVINKFNGKNNEPKAFYENINSLGAIVFKNSANNFKTLSINTQIAIFGDKNWDIEDFKTYNMEKIEKYKEIYGIDKTYNFHSFIFPGTILLDKQNKEFYYISSIQTVRDIIEIKFLNKIEFKDENKNQDTSKTPKRLMFGIKSIMNNYEQVDISPFGINKKIFE

SEQ ID NO: 61 - protein, 1119 aa, Lactobacillus coryniformis KCTC 3535
MGYRIGLDVGITSTGYAVLKTDKNGLPYKILTLDSVIYPRAENPQTGASLAEPRRIKRGLRRRTRRTKFRKQRTQQLFIHSGLLSKPEIEQILATPQAKYSVYELRVAGLDRRLTNSELFRVLYFFIGHRGFKSNRKAELNPENEADKKQMGQLLNSIEEIRKAIAEKGYRTVGELYLKDPKYNDHKRNKGYIDGYLSTPNRQMLVDEIKQILDKQRELGNEKLTDEFYATYLLGDENRAGIFQAQRDFDEGPGAGPYAGDQIKKMVGKDIFEPTEDRAAKATYTFQYFNLLQKMTSLNYQNTTGDTWHTLNGLDRQAIIDAVFAKAEKPTKTYKPTDFGELRKLLKLPDDARFNLVNYGSLQTQKEIETVEKKTRFVDFKAYHDLVKVLPEEMWQSRQLLDHIGTALTLYSSDKRRRRYFAEELNLPAELIEKLLPLNFSKFGHLSIKSMQNIIPYLEMGQVYSEATTNTGYDFRKKQISKDTIREEITNPVVRRAVTKTIKIVEQIIRRYGKPDGINIELARELGRNFKERGDIQKRQDKNRQTNDKIAAELTELGIPVNGQNIIRYKLHKEQNGVDPYTGDQIPFERAFSEGYEVDHIIPYSISWDDSYTNKVLTSAKCNREKGNRIPMVYLANNEQRLNALTNIADNIIRNSRKRQKLLKQKLSDEELKDWKQRNINDTRFITRVLYNYFRQAIEFNPELEKKQRVLPLNGEVTSKIRSRWGFLKVREDGDLHHAIDATVIAAITPKFIQQVTKYSQHQEVKNNQALWHDAEIKDAEYAAEAQRMDADLFNKIFNGFPLPWPEFLDELLARISDNPVEMMKSRSWNTYTPIEIAKLKPVFVVRLANHKISGPAHLDTIRSAKLFDEKGIVLSRVSITKLKINKKGQVATGDGIYDPENSNNGDKVVYSAIRQALEAHNGSGELAFPDGYLEYVDHGTKKLVRKVRVAKKVSLPVRLKNKAAADNGSMVRIDVFNTGKKFVFVPIYIKDTVEQVLPNKAIARGKSLWYQITESDQFCFSLYPGDMVHIESKTGIKPKYSNKENNTSVVPIKNFYGYFDGADIATASILVRAHDSSYTARSIGIAGLLKFEKYQVDYFGRYHKVHEKKRQLFVKRDE

SEQ ID NO: 62 - protein, 1195 aa, Elusimicrobium minutum Pei191
MQKNINTKQNHIYIKQAQKIKEKLGDKPYRIGLDLGVGSIGFAIVSMEENDGNVLLPKEIIMVGSRIFKASAGAADRKLSRGQRNNHRHTRERMRYLWKVLAEQKLALPVPADLDRKENSSEGETSAKRFLGDVLQKDIYELRVKSLDERLSLQELGYVLYHIAGHRGSSAIRTFENDSEEAQKENTENKKIAGNIKRLMAKKNYRTYGEYLYKEFFENKEKHKREKISNAANNHKFSPTRDLVIKEAEAILKKQAGKDGFHKELTEEYIEKLTKAIGYESEKLIPESGFCPYLKDEKRLPASHKLNEERRLWETLNNARYSDPIVDIVTGEITGYYEKQFTKEQKQKLFDYLLTGSELTPAQTKKLLGLKNTNFEDIILQGRDKKAQKIKGYKLIKLESMPFWARLSEAQQDSFLYDWNSCPDEKLLTEKLSNEYHLTEEEIDNAFNEIVLSSSYAPLGKSAMLIILEKIKNDLSYTEAVEEALKEGKLTKEKQAIKDRLPYYGAVLQESTQKIIAKGFSPQFKDKGYKTPHTNKYELEYGRIANPVVHQTLNELRKLVNEIIDILGKKPCEIGLETARELKKSAEDRSKLSREQNDNESNRNRIYEIYIRPQQQVIITRRENPRNYILKFELLEEQKSQCPFCGGQISPNDIINNQADIEHLFPIAESEDNGRNNLVISHSACNADKAKRSPWAAFASAAKDSKYDYNRILSNVKENIPHKAWRFNQGAFEKFIENKPMAARFKTDNSYISKVAHKYLACLFEKPNIICVKGSLTAQLRMAWGLQGLMIPFAKQLITEKESESFNKDVNSNKKIRLDNRHHALDAIVIAYASRGYGNLLNKMAGKDYKINYSERNWLSKILLPPNNIVWENIDADLESFESSVKTALKNAFISVKHDHSDNGELVKGTMYKIFYSERGYTLTTYKKLSALKLTDPQKKKTPKDFLETALLKFKGRESEMKNEKIKSAIENNKRLFDVIQDNLEKAKKLLEEENEKSKAEGKKEKNINDASIYQKAISLSGDKYVQLSKKEPGKFFAISKPTPTTTGYGYDTGDSLCVDLYYDNKGKLCGEIIRKIDAQQKNPLKYKEQGFTLFERIYGGDILEVDFDIHSDKNSFRNNTGSAPENRVFIKVGTFTEITNNNIQIWFGNIIKSTGGQDDSFTINSMQQYNPRKLILSSCGFIKYRSPILKNKEG

SEQ ID NO: 63 - protein, 1082 aa, Neisseria meningitidis Z2491
MAAFKPNPINYILGLDIGIASVGWAMVEIDEDENPICLIDLGVRVFERAEVPKTGDSLAMARRLARSVRRLTRRRAHRLLRARRLLKREGVLQAADFDENGLIKSLPNTPWQLRAAALDRKLTPLEWSAVLLHLIKHRGYLSQRKNEGETADKELGALLKGVADNAHALQTGDFRTPAELALNKFEKESGHIRNQRGDYSHTFSRKDLQAELILLFEKQKEFGNPHVSGGLKEGIETLLMTQRPALSGDAVQKMLGHCTFEPAEPKAAKNTYTAERFIWLTKLNNLRILEQGSERPLTDTERATLMDEPYRKSKLTYAQARKLLGLEDTAFFKGLRYGKDNAEASTLMEMKAYHAISRALEKEGLKDKKSPLNLSPELQDEIGTAFSLFKTDEDITGRLKDRIQPEILEALLKHISFDKFVQISLKALRRIVPLMEQGKRYDEACAEIYGDHYGKKNTEEKIYLPPIPADEIRNPVVLRALSQARKVINGVVRRYGSPARIHIETAREVGKSFKDRKEIEKRQEENRKDREKAAAKFREYFPNFVGEPKSKDILKLRLYEQQHGKCLYSGKEINLGRLNEKGYVEIDHALPFSRTWDDSFNNKVLVLGSENQNKGNQTPYEYFNGKDNSREWQEFKARVETSRFPRSKKQRILLQKFDEDGFKERNLNDTRYVNRFLCQFVADRMRLTGKGKKRVFASNGQITNLLRGFWGLRKVRAENDRHHALDAVVVACSTVAMQQKITRFVRYKEMNAFDGKTIDKETGEVLHQKTHFPQPWEFFAQEVMIRVFGKPDGKPEFEEADTPEKLRTLLAEKLSSRPEAVHEYVTPLFVSRAPNRKMSGQGHMETVKSAKRLDEGVSVLRVPLTQLKLKDLEKMVNREREPKLYEALKARLEAHKDDPAKAFAEPFYKYDKAGNRTQQVKAVRVEQVQKTGVWVRNHNGIADNATMVRVDVFEKGDKYYLVPIYSWQVAKGILPDRAVVQGKDEEDWQLIDDSFNFKFSLHPNDLVEVITKKARMFGYFASCHRGTGNINIRIHDLDHKIGKNGILEGIGVKTALSFQKYQIDELGKEIRPCRLKKRPPVR

SEQ ID NO: 64 - protein, 1056 aa, Pasteurella multocida str. Pm70
MQTTNLSYILGLDLGIASVGWAVVEINENEDPIGLIDVGVRIFERAEVPKTGESLALSRRLARSTRRLIRRRAHRLLLAKRFLKREGILSTIDLEKGLPNQAWELRVAGLERRLSAIEWGAVLLHLIKHRGYLSKRKNESQTNNKELGALLSGVAQNHQLLQSDDYRTPAELALKKFAKEEGHIRNQRGAYTHTFNRLDLLAELNLLFAQQHQFGNPHCKEHIQQYMTELLMWQKPALSGEAILKMLGKCTHEKNEFKAAKHTYSAERFVWLTKLNNLRILEDGAERALNEEERQLLINHPYEKSKLTYAQVRKLLGLSEQAIFKHLRYSKENAESATFMELKAWHAIRKALENQGLKDTWQDLAKKPDLLDEIGTAFSLYKTDEDIQQYLTNKVPNSVINALLVSLNFDKFIELSLKSLRKILPLMEQGKRYDQACREIYGHHYGEANQKTSQLLPAIPAQEIRNPVVLRTLSQARKVINAIIRQYGSPARVHIETGRELGKSFKERREIQKQQEDNRTKRESAVQKFKELFSDFSSEPKSKDILKFRLYEQQHGKCLYSGKEINIHRLNEKGYVEIDHALPFSRTWDDSFNNKVLVLASENQNKGNQTPYEWLQGKINSERWKNFVALVLGSQCSAAKKQRLLTQVIDDNKFIDRNLNDTRYIARFLSNYIQENLLLVGKNKKNVFTPNGQITALLRSRWGLIKARENNNRHHALDAIVVACATPSMQQKITRFIRFKEVHPYKIENRYEMVDQESGEIISPHFPEPWAYFRQEVNIRVFDNHPDTVLKEMLPDRPQANHQFVQPLFVSRAPTRKMSGQGHMETIKSAKRLAEGISVLRIPLTQLKPNLLENMVNKEREPALYAGLKARLAEFNQDPAKAFATPFYKQGGQQVKAIRVEQVQKSGVLVRENNGVADNASIVRTDVFIKNNKFFLVPIYTWQVAKGILPNKAIVAHKNEDEWEEMDEGAKFKFSLFPNDLVELKTKKEYFFGYYIGLDRATGNISLKEHDGEISKGKDGVYRVGVKLALSFEKYQVDELGKNRQICRPQQRQPVR

SEQ ID NO: 65 - protein, 1059 aa, Rhodovulum sp. PH10
MGIRFAFDLGTNSIGWAVWRTGPGVFGEDTAASLDGSGVLIFKDGRNPKDGQSLATMRRVPRQSRKRRDRFVLRRRDLLAALRKAGLFPVDVEEGRRLAATDPYHLRAKALDESLTPHEMGRVIFHLNQRRGFRSNRKADRQDREKGKIAEGSKRLAETLAATNCRTLGEFLWSRHRGTPRTRSPTRIRMEGEGAKALYAFYPTREMVRAEFERLWTAQSRFAPDLLTPERHEEIAGILFRQRDLAPPKIGCCTFEPSERRLPRALPSVEARGIYERLAHLRITTGPVSDRGLTRPERDVLASALLAGKSLTFKAVRKTLKILPHALVNFEEAGEKGLDGALTAKLLSKPDHYGAAWHGLSFAEKDTFVGKLLDEADEERLIRRLVTENRLSEDAARRCASIPLADGYGRLGRTANTEILAALVEETDETGTVVTYAEAVRRAGERTGRNWHHSDERDGVILDRLPYYGEILQRHVVPGSGEPEEKNEAARWGRLANPTVHIGLNQLRKVVNRLIAAHGRPDQIVVELARELKLNREQKERLDRENRKNREENERRTAILAEHGQRDTAENKIRLRLFEEQARANAGIALCPYTGRAIGIAELFTSEVEIDHILPVSLTLDDSLANRVLCRREANREKRRQTPFQAFGATPAWNDIVARAAKLPPNKRWRFDPAALERFEREGGFLGRQLNETKYLSRLAKIYLGKICDPDRVYVTPGTLTGLLRARWGLNSILSDSNFKNRSDHRHHAVDAVVIGVLTRGMIQRIAHDAARAEDQDLDRVFRDVPVPFEDFRDHVRERVSTITVAVKPEHGKGGALHEDTSYGLVPDTDPNAALGNLVVRKPIRSLTAGEVDRVRDRALRARLGALAAPFRDESGRVRDAKGLAQALEAFGAENGIRRVRILKPDASVVTIADRRTGVPYRAVAPGENHHVDIVQMRDGSWRGFAASVFEVNRPGWRPEWEVKKLGGKLVMRLHKGDMVELSDKDGQRRVKVVQQIEISANRVRLSPHNDGGKLQDRHADADDPFRWDLATIPLLKDRGCVAVRVDPIGVVTLRRSNV

SEQ ID NO: 66 - protein, 1096 aa, Eubacterium dolichum DSM 3991
MMEVFMGRLVLGLDIGITSVGFGIIDLDESEIVDYGVRLFKEGTAAENETRRTKRGGRRLKRRRVTRREDMLHLLKQAGIISTSFHPLNNPYDVRVKGLNERLNGEELATALLHLCKHRGSSVETIEDDEAKAKEAGETKKVLSMNDQLLKSGKYVCEIQKERLRTNGHIRGHENNFKTRAYVDEAFQILSHQDLSNELKSAIITIISRKRMYYDGPGGPLSPTPYGRYTYFGQKEPIDLIEKMRGKCSLFPNEPRAPKLAYSAELFNLLNDLNNLSIEGEKLTSEQKAMILKIVHEKGKITPKQLAKEVGVSLEQIRGFRIDTKGSPLLSELTGYKMIREVLEKSNDEHLEDHVFYDEIAEILTKTKDIEGRKKQISELSSDLNEESVHQLAGLTKFTAYHSLSFKALRLINEEMLKTELNQMQSITLFGLKQNNELSVKGMKNIQADDTAILSPVAKRAQRETFKVVNRLREIYGEFDSIVVEMAREKNSEEQRKAIRERQKFFEMRNKQVADIIGDDRKINAKLREKLVLYQEQDGKTAYSLEPIDLKLLIDDPNAYEVDHIIPISISLDDSITNKVLVTHRENQEKGNLTPISAFVKGRFTKGSLAQYKAYCLKLKEKNIKTNKGYRKKVEQYLLNENDIYKYDIQKEFINRNLVDTSYASRVVLNTLTTYFKQNEIPTKVFTVKGSLTNAFRRKINLKKDRDEDYGHHAIDALIIASMPKMRLLSTIFSRYKIEDIYDESTGEVFSSGDDSMYYDDRYFAFIASLKAIKVRKFSHKIDTKPNRSVADETIYSTRVIDGKEKVVKKYKDIYDPKFTALAEDILNNAYQEKYLMALHDPQTFDQIVKVVNYYFEEMSKSEKYFTKDKKGRIKISGMNPLSLYRDEHGMLKKYSKKGDGPAITQMKYFDGVLGNHIDISAHYQVRDKKVVLQQISPYRTDFYYSKENGYKFVTIRYKDVRWSEKKKKYVIDQQDYAMKKAEKKIDDTYEFQFSMHRDELIGITKAEGEALIYPDETWHNFNFFFHAGETPEILKFTATNNDKSNKIEVKPIHCYCKMRLMPTISKKIVRIDKYATDVVGNLYKVKKNTLKFEFD

SEQ ID NO: 67 - protein, 1132 aa, Nitratifractor salsuginis DSM 16511
MKKILGVDLGITSFGYAILQETGKDLYRCLDNSVVMRNNPYDEKSGESSQSIRSTQKSMRRLIEKRKKRIRCVAQTMERYGILDYSETMKINDPKNNPIKNRWQLRAVDAWKRPLSPQELFAIFAHMAKHRGYKSIATEDLIYELELELGLNDPEKESEKKADERRQVYNALRHLEELRKKYGGETIAQTIHRAVEAGDLRSYRNHDDYEKMIRREDIEEEIEKVLLRQAELGALGLPEEQVSELIDELKACITDQEMPTIDESLFGKCTFYKDELAAPAYSYLYDLYRLYKKLADLNIDGYEVTQEDREKVIEWVEKKIAQGKNLKKITHKDLRKILGLAPEQKIFGVEDERIVKGKKEPRTFVPFFFLADIAKFKELFASIQKHPDALQIFRELAEILQRSKTPQEALDRLRALMAGKGIDTDDRELLELFKNKRSGTRELSHRYILEALPLFLEGYDEKEVQRILGFDDREDYSRYPKSLRHLHLREGNLFEKEENPINNHAVKSLASWALGLIADLSWRYGPFDEIILETTRDALPEKIRKEIDKAMREREKALDKIIGKYKKEFPSIDKRLARKIQLWERQKGLDLYSGKVINLSQLLDGSADIEHIVPQSLGGLSTDYNTIVTLKSVNAAKGNRLPGDWLAGNPDYRERIGMLSEKGLIDWKKRKNLLAQSLDEIYTENTHSKGIRATSYLEALVAQVLKRYYPFPDPELRKNGIGVRMIPGKVTSKTRSLLGIKSKSRETNFHHAEDALILSTLTRGWQNRLHRMLRDNYGKSEAELKELWKKYMPHIEGLTLADYIDEAFRRFMSKGEESLFYRDMFDTIRSISYWVDKKPLSASSHKETVYSSRHEVPTLRKNILEAFDSLNVIKDRHKLTTEEFMKRYDKEIRQKLWLHRIGNTNDESYRAVEERATQIAQILTRYQLMDAQNDKEIDEKFQQALKELITSPIEVTGKLLRKMRFVYDKLNAMQIDRGLVETDKNMLGIHISKGPNEKLIFRRMDVNNAHELQKERSGILCYLNEMLFIFNKKGLIHYGCLRSYLEKGQGSKYIALFNPRFPANPKAQPSKFTSDSKIKQVGIGSATGIIKAHLDLDGHVRSYEVFGTLPEGSIEWFKEESGYGRVEDDPHH

SEQ ID NO: 68 - protein, 1173 aa, Rhodospirillum rubrum ATCC 11170
MRPIEPWILGLDIGTDSLGWAVFSCEEKGPPTAKELLGGGVRLFDSGRDAKDHTSRQAERGAFRRARRQTRTWPWRRDRLIALFQAAGLTPPAAETRQIALALRREAVSRPLAPDALWAALLHLAHHRGFRSNRIDKRERAAAKALAKAKPAKATAKATAPAKEADDEAGFWEGAEAALRQRMAASGAPTVGALLADDLDRGQPVRMRYNQSDRDGVVAPTRALIAEELAEIVARQSSAYPGLDWPAVTRLVLDQRPLRSKGAGPCAFLPGEDRALRALPTVQDFIIRQTLANLRLPSTSADEPRPLTDEEHAKALALLSTARFVEWPALRRALGLKRGVKFTAETERNGAKQAARGTAGNLTEAILAPLIPGWSGWDLDRKDRVFSDLWAARQDRSALLALIGDPRGPTRVTEDETAEAVADAIQIVLPTGRASLSAKAARAIAQAMAPGIGYDEAVTLALGLHHSHRPRQERLARLPYYAAALPDVGLDGDPVGPPPAEDDGAAAEAYYGRIGNISVHIALNETRKIVNALLHRHGPILRLVMVETTRELKAGADERKRMIAEQAERERENAEIDVELRKSDRWMANARERRQRVRLARRQNNLCPYTSTPIGHADLLGDAYDIDHVIPLARGGRDSLDNMVLCQSDANKTKGDKTPWEAFHDKPGWIAQRDDFLARLDPQTAKALAWRFADDAGERVARKSAEDEDQGFLPRQLTDTGYIARVALRYLSLVTNEPNAVVATNGRLTGLLRLAWDITPGPAPRDLLPTPRDALRDDTAARRFLDGLTPPPLAKAVEGAVQARLAALGRSRVADAGLADALGLTLASLGGGGKNRADHRHHFIDAAMIAVTTRGLINQINQASGAGRILDLRKWPRTNFEPPYPTFRAEVMKQWDHIHPSIRPAHRDGGSLHAATVFGVRNRPDARVLVQRKPVEKLFLDANAKPLPADKIAEIIDGFASPRMAKRFKALLARYQAAHPEVPPALAALAVARDPAFGPRGMTANTVIAGRSDGDGEDAGLITPFRANPKAAVRTMGNAVYEVWEIQVKGRPRWTHRVLTRFDRTQPAPPPPPENARLVMRLRRGDLVYWPLESGDRLFLVKKMAVDGRLALWPARLATGKATALYAQLSCPNINLNGDQGYCVQSAEGIRKEKIRTTSCTALGRLRLSKKAT

SEQ ID NO: 69 - protein, 1021 aa, Clostridium cellulolyticum H10
MKYTLGLDVGIASVGWAVIDKDNNKIIDLGVRCFDKAEESKTGESLATARRIARGMRRRISRRSQRLRLVKKLFVQYEIIKDSSEFNRIFDTSRDGWKDPWELRYNALSRILKPYELVQVLTHITKRRGFKSNRKEDLSTTKEGVVITSIKNNSEMLRTKNYRTIGEMIFMETPENSNKRNKVDEYIHTIAREDLLNEIKYIFSIQRKLGSPFVTEKLEHDFLNIWEFQRPFASGDSILSKVGKCTLLKEELRAPTSCYTSEYFGLLQSINNLVLVEDNNTLTLNNDQRAKIIEYAHFKNEIKYSEIRKLLDIEPEILFKAHNLTHKNPSGNNESKKFYEMKSYHKLKSTLPTDIWGKLHSNKESLDNLFYCLTVYKNDNEIKDYLQANNLDYLIEYIAKLPTFNKFKHLSLVAMKRIIPFMEKGYKYSDACNMAELDFTGSSKLEKCNKLTVEPIIENVTNPVVIRALTQARKVINAIIQKYGLPYMVNIELAREAGMTRQDRDNLKKEHENNRKAREKISDLIRQNGRVASGLDILKWRLWEDQGGRCAYSGKPIPVCDLLNDSLTQIDHIYPYSRSMDDSYMNKVLVLTDENQNKRSYTPYEVWGSTEKWEDFEARIYSMHLPQSKEKRLLNRNFITKDLDSFISRNLNDTRYISRFLKNYIESYLQFSNDSPKSCVVCVNGQCTAQLRSRWGLNKNREESDLHHALDAAVIACADRKIIKEITNYYNERENHNYKVKYPLPWHSFRQDLMETLAGVFISRAPRRKITGPAHDETIRSPKHFNKGLTSVKIPLTTVTLEKLETMVKNTKGGISDKAVYNVLKNRLIEHNNKPLKAFAEKIYKPLKNGTNGAIIRSIRVETPSYTGVFRNEGKGISDNSLMVRVDVFKKKDKYYLVPIYVAHMIKKELPSKAIVPLKPESQWELIDSTHEFLFSLYQNDYLVIKTKKGITEGYYRSCHRGTGSLSLMPHFANNKNVKIDIGVRTAISIEKYNVDILGNKSIVKGEPRRGMEKYNSFKSN

SEQ ID NO: 70 - protein, 1024 aa, Helicobacter mustelae 12198
MIRTLGIDIGIASIGWAVIEGEYTDKGLENKEIVASGVRVFTKAENPKNKESLALPRTLARSARRRNARKKGRIQQVKHYLSKALGLDLECFVQGEKLATLFQTSKDFLSPWELRERALYRVLDKEELARVILHIAKRRGYDDITYGVEDNDSGKIKKAIAENSKRIKEEQCKTIGEMMYKLYFQKSLNVRNKKESYNRCVGRSELREELKTIFQIQQELKSPWVNEELIYKLLGNPDAQSKQEREGLIFYQRPLKGFGDKIGKCSHIKKGENSPYRACKHAPSAEEFVALTKSINFLKNLTNRHGLCFSQEDMCVYLGKILQEAQKNEKGLTYSKLKLLLDLPSDFEFLGLDYSGKNPEKAVFLSLPSTFKLNKITQDRKTQDKIANILGANKDWEAILKELESLQLSKEQIQTIKDAKLNFSKHINLSLEALYHLLPLMREGKRYDEGVEILQERGIFSKPQPKNRQLLPPLSELAKEESYFDIPNPVLRRALSEFRKVVNALLEKYGGFHYFHIELTRDVCKAKSARMQLEKINKKNKSENDAASQLLEVLGLPNTYNNRLKCKLWKQQEEYCLYSGEKITIDHLKDQRALQIDHAFPLSRSLDDSQSNKVLCLTSSNQEKSNKTPYEWLGSDEKKWDMYVGRVYSSNFSPSKKRKLTQKNFKERNEEDFLARNLVDTGYIGRVTKEYIKHSLSFLPLPDGKKEHIRIISGSMTSTMRSFWGVQEKNRDHHLHHAQDAIIIACIEPSMIQKYTTYLKDKETHRLKSHQKAQILREGDHKLSLRWPMSNFKDKIQESIQNIIPSHHVSHKVTGELHQETVRTKEFYYQAFGGEEGVKKALKFGKIREINQGIVDNGAMVRVDIFKSKDKGKFYAVPIYTYDFAIGKLPNKAIVQGKKNGIIKDWLEMDENYEFCFSLFKNDCIKIQTKEMQEAVLAIYKSTNSAKATIELEHLSKYALKNEDEEKMFTDTDKEKNKTMTRESCGIQGLKVFQKVKLSVLGEVLEHKPRNRQNIALKTTPKHV

SEQ ID NO: 71 - protein, 1092 aa, Ilyobacter polytropus DSM 2926
MKYSIGLDIGIASVGWSVINKDKERIEDMGVRIFQKAENPKDGSSLASSRREKRGSRRRNRRKKHRLDRIKNILCESGLVKKNEIEKIYKNAYLKSPWELRAKSLEAKISNKEIAQILLHIAKRRGFKSFRKTDRNADDTGKLLSGIQENKKIMEEKGYLTIGDMVAKDPKFNTHVRNKAGSYLFSFSRKLLEDEVRKIQAKQKELGNTHFTDDVLEKYIEVFNSQRNFDEGPSKPSPYYSEIGQIAKMIGNCTFESSEKRTAKNTWSGERFVFLQKLNNFRIVGLSGKRPLTEEERDIVEKEVYLKKEVRYEKLRKILYLKEEERFGDLNYSKDEKQDKKTEKTKFISLIGNYTIKKLNLSEKLKSEIEEDKSKLDKIIEILTFNKSDKTIESNLKKLELSREDIEILLSEEFSGTLNLSLKAIKKILPYLEKGLSYNEACEKADYDYKNNGIKFKRGELLPVVDKDLIANPVVLRAISQTRKVVNAIIRKYGTPHTIHVEVARDLAKSYDDRQTIIKENKKRELENEKTKKFISEEFGIKNVKGKLLLKYRLYQEQEGRCAYSRKELSLSEVILDESMTDIDHIIPYSRSMDDSYSNKVLVLSGENRKKSNLLPKEYFDRQGRDWDTFVLNVKAMKIHPRKKSNLLKEKFTREDNKDWKSRALNDTRYISRFVANYLENALEYRDDSPKKRVFMIPGQLTAQLRARWRLNKVRENGDLHHALDAAVVAVTDQKAINNISNISRYKELKNCKDVIPSIEYHADEETGEVYFEEVKDTRFPMPWSGFDLELQKRLESENPREEFYNLLSDKRYLGWFNYEEGFIEKLRPVFVSRMPNRGVKGQAHQETIRSSKKISNQIAVSKKPLNSIKLKDLEKMQGRDTDRKLYEALKNRLEEYDDKPEKAFAEPFYKPTNSGKRGPLVRGIKVEEKQNVGVYVNGGQASNGSMVRIDVFRKNGKFYTVPIYVHQTLLKELPNRAINGKPYKDWDLIDGSFEFLYSFYPNDLIEIEFGKSKSIKNDNKLTKTEIPEVNLSEVLGYYRGMDTSTGAATIDTQDGKIQMRIGIKTVKNIKKYQVDVLGNVYKVKREKRQTF

SEQ ID NO: 72 - protein, 1179 aa, Sphaerochaeta globus str. Buddy
MSKKVSRRYEEQAQEICQRLGSRPYSIGLDLGVGSIGVAVAAYDPIKKQPSDLVFVSSRIFIPSTGAAERRQKRGQRNSLRHRANRLKFLWKLLAERNLMLSYSEQDVPDPARLRFEDAVVRANPYELRLKGLNEQLTLSELGYALYHIANHRGSSSVRTFLDEEKSSDDKKLEEQQAMTEQLAKEKGISTFIEVLTAFNTNGLIGYRNSESVKSKGVPVPTRDIISNEIDVLLQTQKQFYQEILSDEYCDRIVSAILFENEKIVPEAGCCPYFPDEKKLPRCHFLNEERRLWEAINNARIKMPMQEGAAKRYQSASFSDEQRHILFHIARSGTDITPKLVQKEFPALKTSIIVLQGKEKAIQKIAGFRFRRLEEKSFWKRLSEEQKDDFFSAWTNTPDDKRLSKYLMKHLLLTENEVVDALKTVSLIGDYGPIGKTATQLLMKHLEDGLTYTEALERGMETGEFQELSVWEQQSLLPYYGQILTGSTQALMGKYWHSAFKEKRDSEGFFKPNTNSDEEKYGRIANPVVHQTLNELRKLMNELITILGAKPQEITVELARELKVGAEKREDIIKQQTKQEKEAVLAYSKYCEPNNLDKRYIERFRLLEDQAFVCPYCLEHISVADIAAGRADVDHIFPRDDTADNSYGNKVVAHRQCNDIKGKRTPYAAFSNTSAWGPIMHYLDETPGMWRKRRKFETNEEEYAKYLQSKGFVSRFESDNSYIAKAAKEYLRCLFNPNNVTAVGSLKGMETSILRKAWNLQGIDDLLGSRHWSKDADTSPTMRKNRDDNRHHGLDAIVALYCSRSLVQMINTMSEQGKRAVEIEAMIPIPGYASEPNLSFEAQRELFRKKILEFMDLHAFVSMKTDNDANGALLKDTVYSILGADTQGEDLVFVVKKKIKDIGVKIGDYEEVASAIRGRITDKQPKWYPMEMKDKIEQLQSKNEAALQKYKESLVQAAAVLEESNRKLIESGKKPIQLSEKTISKKALELVGGYYYLISNNKRTKTFVVKEPSNEVKGFAFDTGSNLCLDFYHDAQGKLCGEIIRKIQAMNPSYKPAYMKQGYSLYVRLYQGDVCELRASDLTEAESNLAKTTHVRLPNAKPGRTFVIIITFTEMGSGYQIYFSNLAKSKKGQDTSFTLTTIKNYDVRKVQLSSAGLVRYVSPLLVDKIEKDEVALCGE

SEQ ID NO: 73 - protein, 1054 aa, Staphylococcus lugdunensis M23590
MNQKFILGLDIGITSVGYGLIDYETKNIIDAGVRLFPEANVENNEGRRSKRGSRRLKRRRIHRLERVKKLLEDYNLLDQSQIPQSTNPYAIRVKGLSEALSKDELVIALLHIAKRRGIHKIDVIDSNDDVGNELSTKEQLNKNSKLLKDKFVCQIQLERMNEGQVRGEKNRFKTADIIKEIIQLLNVQKNFHQLDENFINKYIELVEMRREYFEGPGKGSPYGWEGDPKAWYETLMGHCTYFPDELRSVKYAYSADLFNALNDLNNLVIQRDGLSKLEYHEKYHIIENVFKQKKKPTLKQIANEINVNPEDIKGYRITKSGKPQFTEFKLYHDLKSVLFDQSILENEDVLDQIAEILTIYQDKDSIKSKLTELDILLNEEDKENIAQLTGYTGTHRLSLKCIRLVLEEQWYSSRNQMEIFTHLNIKPKKINLTAANKIPKAMIDEFILSPVVKRTFGQAINLINKIIEKYGVPEDIIIELARENNSKDKQKFINEMQKKNENTRKRINEIIGKYGNQNAKRLVEKIRLHDEQEGKCLYSLESIPLEDLLNNPNHYEVDHIIPRSVSFDNSYHNKVLVKQSENSKKSNLTPYQYFNSGKSKLSYNQFKQHILNLSKSQDRISKKKKEYLLEERDINKFEVQKEFINRNLVDTRYATRELTNYLKAYFSANNMNVKVKTINGSFTDYLRKVWKFKKERNHGYKHHAEDALIIANADFLFKENKKLKAVNSVLEKPEIESKQLDIQVDSEDNYSEMFIIPKQVQDIKDFRNFKYSHRVDKKPNRQLINDTLYSTRKKDNSTYIVQTIKDIYAKDNTTLKKQFDKSPEKFLMYQHDPRTFEKLEVIMKQYANEKNPLAKYHEETGEYLTKYSKKNNGPIVKSLKYIGNKLGSHLDVTHQFKSSTKKLVKLSIKPYRFDVYLTDKGYKFITISYLDVLKKDNYYYIPEQKYDKLKLGKAIDKNAKFIASFYKNDLIKLDGEIYKIIGVNSDTRNMIELDLPDIRYKEYCELNNIKGEPRIKKTIGKKVNSIEKLTTDVLGNVFTNTQYTKPQLLFKRGN

SEQ ID NO: 74 - protein, 1061 aa, Treponema sp. JC4
MIMKLEKWRLGLDLGTNSIGWSVFSLDKDNSVQDLIDMGVRIFSDGRDPKTKEPLAVARRTARSQRKLIYRRKLRRKQVFKFLQEQGLFPKTKEECMTLKSLNPYELRIKALDEKLEPYELGRALFNLAVRRGFKSNRKDGSREEVSEKKSPDEIKTQADMQTHLEKAIKENGCRTITEFLYKNQGENGGIRFAPGRMTYYPTRKMYEEEFNLIRSKQEKYYPQVDWDDIYKAIFYQRPLKPQQRGYCIYENDKERTFKAMPCSQKLRILQDIGNLAYYEGGSKKRVELNDNQDKVLYELLNSKDKVTFDQMRKALCLADSNSFNLEENRDFLIGNPTAVKMRSKNRFGKLWDEIPLEEQDLIIETIITADEDDAVYEVIKKYDLTQEQRDFIVKNTILQSGTSMLCKEVSEKLVKRLEEIADLKYHEAVESLGYKFADQTVEKYDLLPYYGKVLPGSTMEIDLSAPETNPEKHYGKISNPTVHVALNQTRVVVNALIKEYGKPSQIAIELSRDLKNNVEKKAEIARKQNQRAKENIAINDTISALYHTAFPGKSFYPNRNDRMKYRLWSELGLGNKCIYCGKGISGAELFTKEIEIEHILPFSRTLLDAESNLTVAHSSCNAFKAERSPFEAFGTNPSGYSWQEIIQRANQLKNTSKKNKFSPNAMDSFEKDSSFIARQLSDNQYIAKAALRYLKCLVENPSDVWTTNGSMTKLLRDKWEMDSILCRKFTEKEVALLGLKPEQIGNYKKNRFDHRHHAIDAVVIGLTDRSMVQKLATKNSHKGNRIEIPEFPILRSDLIEKVKNIVVSFKPDHGAEGKLSKETLLGKIKLHGKETFVCRENIVSLSEKNLDDIVDEIKSKVKDYVAKHKGQKIEAVLSDFSKENGIKKVRCVNRVQTPIEITSGKISRYLSPEDYFAAVIWEIPGEKKTFKAQYIRRNEVEKNSKGLNVVKPAVLENGKPHPAAKQVCLLHKDDYLEFSDKGKMYFCRIAGYAATNNKLDIRPVYAVSYCADWINSTNETMLTGYWKPTPTQNWVSVNVLFDKQKARLVTVSPIGRVFRK

SEQ ID NO: 75 - protein, 1011 aa, Uncultured delta proteobacterium HF0070 07E19
MSSKAIDSLEQLDLFKPQEYTLGLDLGIKSIGWAILSGERIANAGVYLFETAEELNSTGNKLISKAAERGRKRRIRRMLDRKARRGRHIRYLLEREGLPTDELEEVVVHQSNRTLWDVRAEAVERKLTKQELAAVLFHLVRHRGYFPNTKKLPPDDESDSADEEQGKINRATSRLREELKASDCKTIGQFLAQNRDRQRNREGDYSNLMARKLVFEEALQILAFQRKQGHELSKDFEKTYLDVLMGQRSGRSPKLGNCSLIPSELRAPSSAPSTEWFKFLQNLGNLQISNAYREEWSIDAPRRAQIIDACSQRSTSSYWQIRRDFQIPDEYRFNLVNYERRDPDVDLQEYLQQQERKTLANFRNWKQLEKIIGTGHPIQTLDEAARLITLIKDDEKLSDQLADLLPEASDKAITQLCELDFTTAAKISLEAMYRILPHMNQGMGFFDACQQESLPEIGVPPAGDRVPPFDEMYNPVVNRVLSQSRKLINAVIDEYGMPAKIRVELARDLGKGRELRERIKLDQLDKSKQNDQRAEDFRAEFQQAPRGDQSLRYRLWKEQNCTCPYSGRMIPVNSVLSEDTQIDHILPISQSFDNSLSNKVLCFTEENAQKSNRTPFEYLDAADFQRLEAISGNWPEAKRNKLLHKSFGKVAEEWKSRALNDTRYLTSALADHLRHHLPDSKIQTVNGRITGYLRKQWGLEKDRDKHTHHAVDAIVVACTTPAIVQQVTLYHQDIRRYKKLGEKRPTPWPETFRQDVLDVEEEIFITRQPKKVSGGIQTKDTLRKHRSKPDRQRVALTKVKLADLERLVEKDASNRNLYEHLKQCLEESGDQPTKAFKAPFYMPSGPEAKQRPILSKVTLLREKPEPPKQLTELSGGRRYDSMAQGRLDIYRYKPGGKRKDEYRVVLQRMIDLMRGEENVHVFQKGVPYDQGPEIEQNYTFLFSLYFDDLVEFQRSADSEVIRGYYRTFNIANGQLKISTYLEGRQDFDFFGANRLAHFAKVQVNLLGKVIK

SEQ ID NO: 76 - protein, 1029 aa, Alicycliphilus denitrificans K601
MRSLRYRLALDLGSTSLGWALFRLDACNRPTAVIKAGVRIFSDGRNPKDGSSLAVTRRAARAMRRRRDRLLKRKTRMQAKLVEHGFFPADAGKRKALEQLNPYALRAKGLQEALLPGEFARALFHINQRRGFKSNRKTDKKDNDSGVLKKAIGQLRQQMAEQGSRTVGEYLWTRLQQGQGVRARYREKPYTTEEGKKRIDKSYDLYIDRAMIEQEFDALWAAQAAFNPTLFHEAARADLKDTLLHQRPLRPVKPGRCTLLPEEERAPLALPSTQRFRIHQEVNHLRLLDENLREVALTLAQRDAVVTALETKAKLSFEQIRKLLKLSGSVQFNLEDAKRTELKGNATSAALARKELFGAAWSGFDEALQDEIVWQLVTEEGEGALIAWLQTHTGVDEARAQAIVDVSLPEGYGNLSRKALARIVPALRAAVITYDKAVQAAGFDHHSQLGFEYDASEVEDLVHPETGEIRSVFKQLPYYGKALQRHVAFGSGKPEDPDEKRYGKIANPTVHIGLNQVRMVVNALIRRYGRPTEVVIELARDLKQSREQKVEAQRRQADNQRRNARIRRSIAEVLGIGEERVRGSDIQKWICWEELSFDAADRRCPYSGVQISAAMLLSDEVEVEHILPFSKTLDDSLNNRTVAMRQANRIKRNRTPWDARAEFEAQGWSYEDILQRAERMPLRKRYRFAPDGYERWLGDDKDFLARALNDTRYLSRVAAEYLRLVCPGTRVIPGQLTALLRGKFGLNDVLGLDGEKNRNDHRHHAVDACVIGVTDQGLMQRFATASAQARGDGLTRLVDGMPMPWPTYRDHVERAVRHIWVSHRPDHGFEGAMMEETSYGIRKDGSIKQRRKADGSAGREISNLIRIHEATQPLRHGVSADGQPLAYKGYVGGSNYCIEITVNDKGKWEGEVISTFRAYGVVRAGGMGRLRNPHEGQNGRKLIMRLVIGDSVRLEVDGAERTMRIVKISGSNGQIFMAPIHEANVDARNTDKQDAFTYTSKYAGSLQKAKTRRVTISPIGEVRDPGFKG

SEQ ID NO: 77 - protein, 1168 aa, Azospirillum sp. B510
MARPAFRAPRREHVNGWTPDPHRISKPFFILVSWHLLSRVVIDSSSGCFPGTSRDHTDKFAEWECAVQPYRLSFDLGTNSIGWGLLNLDRQGKPREIRALGSRIFSDGRDPQDKASLAVARRLARQMRRRRDRYLTRRTRLMGALVRFGLMPADPAARKRLEVAVDPYLARERATRERLEPFEIGRALFHLNQRRGYKPVRTATKPDEEAGKVKEAVERLEAAIAAAGAPTLGAWFAWRKTRGETLRARLAGKGKEAAYPFYPARRMLEAEFDTLWAEQARHHPDLLTAEAREILRHRIFHQRPLKPPPVGRCTLYPDDGRAPRALPSAQRLRLFQELASLRVIHLDLSERPLTPAERDRIVAFVQGRPPKAGRKPGKVQKSVPFEKLRGLLELPPGTGFSLESDKRPELLGDETGARIAPAFGPGWTALPLEEQDALVELLLTEAEPERAIAALTARWALDEATAAKLAGATLPDFHGRYGRRAVAELLPVLERETRGDPDGRVRPIRLDEAVKLLRGGKDHSDFSREGALLDALPYYGAVLERHVAFGTGNPADPEEKRVGRVANPTVHIALNQLRHLVNAILARHGRPEEIVIELARDLKRSAEDRRREDKRQADNQKRNEERKRLILSLGERPTPRNLLKLRLWEEQGPVENRRCPYSGETISMRMLLSEQVDIDHILPFSVSLDDSAANKVVCLREANRIKRNRSPWEAFGHDSERWAGILARAEALPKNKRWRFAPDALEKLEGEGGLRARHLNDTRHLSRLAVEYLRCVCPKVRVSPGRLTALLRRRWGIDAILAEADGPPPEVPAETLDPSPAEKNRADHRHHALDAVVIGCIDRSMVQRVQLAAASAEREAAAREDNIRRVLEGFKEEPWDGFRAELERRARTIVVSHRPEHGIGGALHKETAYGPVDPPEEGFNLVVRKPIDGLSKDEINSVRDPRLRRALIDRLAIRRRDANDPATALAKAAEDLAAQPASRGIRRVRVLKKESNPIRVEHGGNPSGPRSGGPFHKLLLAGEVHHVDVALRADGRRWVGHWVTLFEAHGGRGADGAAAPPRLGDGERFLMRLHKGDCLKLEHKGRVRVMQVVKLEPSSNSVVVVEPHQVKTDRSKHVKISCDQLRARGARRVTVDPLGRVRVHAPGARVGIGGDAGRTAMEPAEDIS

SEQ ID NO: 78 - protein, 1064 aa, Bradyrhizobium sp. BTAi1
MKRTSLRAYRLGVDLGANSLGWFVVWLDDHGQPEGLGPGGVRIFPDGRNPQSKQSNAAGRRLARSARRRRDRYLQRRGKLMGLLVKHGLMPADEPARKRLECLDPYGLRAKALDEVLPLHHVGRALFHLNQRRGLFANRAIEQGDKDASAIKAAAGRLQTSMQACGARTLGEFLNRRHQLRATVRARSPVGGDVQARYEFYPTRAMVDAEFEAIWAAQAPHHPTMTAEAHDTIREAIFSQRAMKRPSIGKCSLDPATSQDDVDGFRCAWSHPLAQRFRIWQDVRNLAVVETGPTSSRLGKEDQDKVARALLQTDQLSFDEIRGLLGLPSDARFNLESDRRDHLKGDATGAILSARRHFGPAWHDRSLDRQIDIVALLESALDEAAIIASLGTTHSLDEAAAQRALSALLPDGYCRLGLRAIKRVLPLMEAGRTYAEAASAAGYDHALLPGGKLSPTGYLPYYGQWLQNDVVGSDDERDTNERRWGRLPNPTVHIGIGQLRRVVNELIRWHGPPAEITVELTRDLKLSPRRLAELEREQAENQRKNDKRTSLLRKLGLPASTHNLLKLRLWDEQGDVASECPYTGEAIGLERLVSDDVDIDHLIPFSISWDDSAANKVVCMRYANREKGNRTPFEAFGHRQGRPYDWADIAERAARLPRGKRWRFGPGARAQFEELGDFQARLLNETSWLARVAKQYLAAVTHPHRIHVLPGRLTALLRATWELNDLLPGSDDRAAKSRKDHRHHAIDALVAALTDQALLRRMANAHDDTRRKIEVLLPWPTFRIDLETRLKAMLVSHKPDHGLQARLHEDTAYGTVEHPETEDGANLVYRKTFVDISEKEIDRIRDRRLRDLVRAHVAGERQQGKTLKAAVLSFAQRRDIAGHPNGIRHVRLTKSIKPDYLVPIRDKAGRIYKSYNAGENAFVDILQAESGRWIARATTVFQANQANESHDAPAAQPIMRVFKGDMLRIDHAGAEKFVKIVRLSPSNNLLYLVEHHQAGVFQTRHDDPEDSFRWLFASFDKLREWNAELVRIDTLGQPWRRKRGLETGSEDATRIGWTRPKKWP

SEQ ID NO: 79 - protein, 1037 aa, Parvibaculum lavamentivorans DS-1
MERIFGFDIGTTSIGFSVIDYSSTQSAGNIQRLGVRIFPEARDPDGTPLNQQRRQKRMMRRQLRRRRIRRKALNETLHEAGFLPAYGSADWPVVMADEPYELRRRGLEEGLSAYEFGRAIYHLAQHRHFKGRELEESDTPDPDVDDEKEAANERAATLKALKNEQTTLGAWLARRPPSDRKRGIHAHRNVVAEEFERLWEVQSKFHPALKSEEMRARISDTIFAQRPVFWRKNTLGECRFMPGEPLCPKGSWLSQQRRMLEKLNNLAIAGGNARPLDAEERDAILSKLQQQASMSWPGVRSALKALYKQRGEPGAEKSLKFNLELGGESKLLGNALEAKLADMFGPDWPAHPRKQEIRHAVHERLWAADYGETPDKKRVIILSEKDRKAHREAAANSFVADFGITGEQAAQLQALKLPTGWEPYSIPALNLFLAELEKGERFGALVNGPDWEGWRRTNFPHRNQPTGEILDKLPSPASKEERERISQLRNPTVVRTQNELRKVVNNLIGLYGKPDRIRIEVGRDVGKSKREREEIQSGIRRNEKQRKKATEDLIKNGIANPSRDDVEKWILWKEGQERCPYTGDQIGFNALFREGRYEVEHIWPRSRSFDNSPRNKTLCRKDVNIEKGNRMPFEAFGHDEDRWSAIQIRLQGMVSAKGGTGMSPGKVKRFLAKTMPEDFAARQLNDTRYAAKQILAQLKRLWPDMGPEAPVKVEAVTGQVTAQLRKLWTLNNILADDGEKTRADHRHHAIDALTVACTHPGMTNKLSRYWQLRDDPRAEKPALTPPWDTIRADAEKAVSEIVVSHRVRKKVSGPLHKETTYGDTGTDIKTKSGTYRQFVTRKKIESLSKGELDEIRDPRIKEIVAAHVAGRGGDPKKAFPPYPCVSPGGPEIRKVRLTSKQQLNLMAQTGNGYADLGSNHHIAIYRLPDGKADFEIVSLFDASRRLAQRNPIVQRTRADGASFVMSLAAGEAIMIPEGSKKGIWIVQGVWASGQVVLERDTDADHSTTTRPMPNPILKDDAKKVSIDPIGRVRPSND

SEQ ID NO: 80 - protein, 1218 aa, Prevotella timonensis CRIS 5C-B1
MNKRILGLDTGTNSLGWAVVDWDEHAQSYELIKYGDVIFQEGVKIEKGIESSKAAERSGYKAIRKQYFRRRLRKIQVLKVLVKYHLCPYLSDDDLRQWHLQKQYPKSDELMLWQRTSDEEGKNPYYDRHRCLHEKLDLTVEADRYTLGRALYHLTQRRGFLSNRLDTSADNKEDGVVKSGISQLSTEMEEAGCEYLGDYFYKLYDAQGNKVRIRQRYTDRNKHYQHEFDAICEKQELSSELIEDLQRAIFFQLPLKSQRHGVGRCTFERGKPRCADSHPDYEEFRMLCFVNNIQVKGPHDLELRPLTYEEREKIEPLFFRKSKPNFDFEDIAKALAGKKNYAWIHDKEERAYKFNYRMTQGVPGCPTIAQLKSIFGDDWKTGIAETYTLIQKKNGSKSLQEMVDDVWNVLYSFSSVEKLKEFAHHKLQLDEESAEKFAKIKLSHSFAALSLKAIRKFLPFLRKGMYYTHASFFANIPTIVGKEIWNKEQNRKYIMENVGELVFNYQPKHREVQGTIEMLIKDFLANNFELPAGATDKLYHPSMIETYPNAQRNEFGILQLGSPRTNAIRNPMAMRSLHILRRVVNQLLKESIIDENTEVHVEYARELNDANKRRAIADRQKEQDKQHKKYGDEIRKLYKEETGKDIEPTQTDVLKFQLWEEQNHHCLYTGEQIGITDFIGSNPKFDIEHTIPQSVGGDSTQMNLTLCDNRFNREVKKAKLPTELANHEEILTRIEPWKNKYEQLVKERDKQRTFAGMDKAVKDIRIQKRHKLQMEIDYWRGKYERFTMTEVPEGFSRRQGTGIGLISRYAGLYLKSLFHQADSRNKSNVYVVKGVATAEFRKMWGLQSEYEKKCRDNHSHHCMDAITIACIGKREYDLMAEYYRMEETFKQGRGSKPKFSKPWATFTEDVLNIYKNLLVVHDTPNNMPKHTKKYVQTSIGKVLAQGDTARGSLHLDTYYGAIERDGEIRYVVRRPLSSFTKPEELENIVDETVKRTIKEAIADKNFKQAIAEPIYMNEEKGILIKKVRCFAKSVKQPINIRQHRDLSKKEYKQQYHVMNENNYLLAIYEGLVKNKVVREFEIVSYIEAAKYYKRSQDRNIFSSIVPTHSTKYGLPLKTKLLMGQLVLMFEENPDEIQVDNTKDLVKRLYKVVGIEKDGRIKFKYHQEARKEGLPIFSTPYKNNDDYAPIFRQSINNINILVDGIDFTIDILGKVTLKE

SEQ ID NO: 81 - protein, 1088 aa, Bacillus smithii 7 3 47FAA
MNYKMGLDIGIASVGWAVINLDLKRIEDLGVRIFDKAEHPQNGESLALPRRIARSARRRLRRRKHRLERIRRLLVSENVLTKEEMNLLFKQKKQIDVWQLRVDALERKLNNDELARVLLHLAKRRGFKSNRKSERNSKESSEFLKNIEENQSILAQYRSVGEMIVKDSKFAYHKRNKLDSYSNMIARDDLEREIKLIFEKQREFNNPVCTERLEEKYLNIWSSQRPFASKEDIEKKVGFCTFEPKEKRAPKATYTFQSFIVWEHINKLRLVSPDETRALTEIERNLLYKQAFSKNKMTYYDIRKLLNLSDDIHFKGLLYDPKSSLKQIENIRFLELDSYHKIRKCIENVYGKDGIRMFNETDIDTFGYALTIFKDDEDIVAYLQNEYITKNGKRVSNLANKVYDKSLIDELLNLSFSKFAHLSMKAIRNILPYMEQGEIYSKACELAGYNFTGPKKKEKALLLPVIPNIANPVVMRALTQSRKVVNAIIKKYGSPVSIHIELARDLSHSFDERKKIQKDQTENRKKNETAIKQLIEYELTKNPTGLDIVKFKLWSEQQGRCMYSLKPIELERLLEPGYVEVDHILPYSRSLDDSYANKVLVLTKENREKGNHTPVEYLGLGSERWKKFEKFVLANKQFSKKKKQNLLRLRYEETEEKEFKERNLNDTRYISKFFANFIKEHLKFADGDGGQKVYTINGKITAHLRSRWDFNKNREESDLHHAVDAVIVACATQGMIKKITEFYKAREQNKESAKKKEPIFPQPWPHFADELKARLSKFPQESIEAFALGNYDRKKLESLRPVFVSRMPKRSVTGAAHQETLRRCVGIDEQSGKIQTAVKTKLSDIKLDKDGHFPMYQKESDPRTYEAIRQRLLEHNNDPKKAFQEPLYKPKKNGEPGPVIRTVKIIDTKNKVVHLDGSKTVAYNSNIVRTDVFEKDGKYYCVPVYTMDIMKGTLPNKAIEANKPYSEWKEMTEEYTFQFSLFPNDLVRIVLPREKTIKTSTNEEIIIKDIFAYYKTIDSATGGLELISHDRNFSLRGVGSKTLKRFEKYQVDVLGNIHKVKGEKRVGLAAPTNQKKGKTVDSLQSVSD

SEQ ID NO: 82 - protein, 1035 aa, Cand. Puniceispirillum marinum IMCC1322
MRRLGLDLGTNSIGWCLLDLGDDGEPVSIFRTGARIFSDGRDPKSLGSLKATRREARLTRRRRDRFIQRQKNLINALVKYGLMPADEIQRQALAYKDPYPIRKKALDEAIDPYEMGRAIFHINQRRGFKSNRKSADNEAGVVKQSIADLEMKLGEAGARTIGEFLADRQATNDTVRARRLSGTNALYEFYPDRYMLEQEFDTLWAKQAAFNPSLYIEAARERLKEIVFFQRKLKPQEVGRCIFLSDEDRISKALPSFQRFRIYQELSNLAWIDHDGVAHRITASLALRDHLFDELEHKKKLTFKAMRAILRKQGVVDYPVGFNLESDNRDHLIGNLTSCIMRDAKKMIGSAWDRLDEEEQDSFILMLQDDQKGDDEVRSILTQQYGLSDDVAEDCLDVRLPDGHGSLSKKAIDRILPVLRDQGLIYYDAVKEAGLGEANLYDPYAALSDKLDYYGKALAGHVMGASGKFEDSDEKRYGTISNPTVHIALNQVRAVVNELIRLHGKPDEVVIEIGRDLPMGADGKRELERFQKEGRAKNERARDELKKLGHIDSRESRQKFQLWEQLAKEPVDRCCPFTGKMMSISDLFSDKVEIEHLLPFSLTLDDSMANKTVCFRQANRDKGNRAPFDAFGNSPAGYDWQEILGRSQNLPYAKRWRFLPDAMKRFEADGGFLERQLNDTRYISRYTTEYISTIIPKNKIWVVTGRLTSLLRGFWGLNSILRGHNTDDGTPAKKSRDDHRHHAIDAIVVGMTSRGLLQKVSKAARRSEDLDLTRLFEGRIDPWDGFRDEVKKHIDAIIVSHRPRKKSQGALHNDTAYGIVEHAENGASTVVHRVPITSLGKQSDIEKVRDPLIKSALLNETAGLSGKSFENAVQKWCADNSIKSLRIVETVSIIPITDKEGVAYKGYKGDGNAYMDIYQDPTSSKWKGEIVSRFDANQKGFIPSWQSQFPTARLIMRLRINDLLKLQDGEIEEIYRVQRLSGSKILMAPHTEANVDARDRDKNDTFKLTSKSPGKLQSASARKVHISPTGLIREG

SEQ ID NO: 83 - protein, 1153 aa, Barnesiella intestinihominis YIT 11860
MKNILGLDLGLSSIGWSVIRENSEEQELVAMGSRVVSLTAAELSSFTQGNGVSINSQRTQKRTQRKGYDRYQLRRTLLRNKLDTLGMLPDDSLSYLPKLQLWGLRAKAVTQRIELNELGRVLLHLNQKRGYKSIKSDFSGDKKITDYVKTVKTRYDELKEMRLTIGELFFRRLTENAFFRCKEQVYPRQAYVEEFDCIMNCQRKFYPDILTDETIRCIRDEIIYYQRPLKSCKYLVSRCEFEKRFYLNAAGKKTEAGPKVSPRTSPLFQVCRLWESINNIVVKDRRNEIVFISAEQRAALFDFLNTHEKLKGSDLLKLLGLSKTYGYRLGEQFKTGIQGNKTRVEIERALGNYPDKKRLLQFNLQEESSSMVNTETGEIIPMISLSFEQEPLYRLWHVLYSIDDREQLQSVLRQKFGIDDDEVLERLSAIDLVKAGFGNKSSKAIRRILPFLQLGMNYAEACEAAGYNHSNNYTKAENEARALLDRLPAIKKNELRQPVVEKILNQMVNVVNALMEKYGRFDEIRVELARELKQSKEERSNTYKSINKNQRENEQIAKRIVEYGVPTRSRIQKYKMWEESKHCCIYCGQPVDVGDFLRGFDVEVEHIIPKSLYFDDSFANKVCSCRSCNKEKNNRTAYDYMKSKGEKALSDYVERVNTMYTNNQISKTKWQNLLTPVDKISIDFIDRQLRESQYIARKAKEILTSICYNVTATSGSVTSFLRHVWGWDTVLHDLNFDRYKKVGLTEVIEVNHRGSVIRREQIKDWSKRFDHRHHAIDALTIACTKQAYIQRLNNLRAEEGPDFNKMSLERYIQSQPHFSVAQVREAVDRILVSFRAGKRAVTPGKRYIRKNRKRISVQSVLIPRGALSEESVYGVIHVWEKDEQGHVIQKQRAVMKYPITSINREMLDKEKVVDKRIHRILSGRLAQYNDNPKEAFAKPVYIDKECRIPIRTVRCFAKPAINTLVPLKKDDKGNPVAWVNPGNNHHVAIYRDEDGKYKERTVTFWEAVDRCRVGIPAIVTQPDTIWDNILQRNDISENVLESLPDVKWQFVLSLQQNEMFILGMNEEDYRYAMDQQDYALLNKYLYRVQKLSKSDYSFRYHTETSVEDKYDGKPNLKLSMQMGKLKRVSIKSLLGLNPHKVHISVLGEIKEIS

SEQ ID NO: 84 - protein, 1062 aa, Ralstonia syzygii R24
MAEKQHRWGLDIGTNSIGWAVIALIEGRPAGLVATGSRIFSDGRNPKDGSSLAVERRGPRQMRRRRDRYLRRRDRFMQALINVGLMPGDAAARKALVTENPYVLRQRGLDQALTLPEFGRALFHLNQRRGFQSNRKTDRATAKESGKVKNAIAAFRAGMGNARTVGEALARRLEDGRPVRARMVGQGKDEHYELYIAREWIAQEFDALWASQQRFHAEVLADAARDRLRAILLFQRKLLPVPVGKCFLEPNQPRVAAALPSAQRFRLMQELNHLRVMTLADKRERPLSFQERNDLLAQLVARPKCGFDMLRKIVFGANKEAYRFTIESERRKELKGCDTAAKLAKVNALGTRWQALSLDEQDRLVCLLLDGENDAVLADALREHYGLTDAQIDTLLGLSFEDGHMRLGRSALLRVLDALESGRDEQGLPLSYDKAVVAAGYPAHTADLENGERDALPYYGELLWRYTQDAPTAKNDAERKFGKIANPTVHIGLNQLRKLVNALIQRYGKPAQIVVELARNLKAGLEEKERIKKQQTANLERNERIRQKLQDAGVPDNRENRLRMRLFEELGQGNGLGTPCIYSGRQISLQRLFSNDVQVDHILPFSKTLDDSFANKVLAQHDANRYKGNRGPFEAFGANRDGYAWDDIRARAAVLPRNKRNRFAETAMQDWLHNETDFLARQLTDTAYLSRVARQYLTAICSKDDVYVSPGRLTAMLRAKWGLNRVLDGVMEEQGRPAVKNRDDHRHHAIDAVVIGATDRAMLQQVATLAARAREQDAERLIGDMPTPWPNFLEDVRAAVARCVVSHKPDHGPEGGLHNDTAYGIVAGPFEDGRYRVRHRVSLFDLKPGDLSNVRCDAPLQAELEPIFEQDDARAREVALTALAERYRQRKVWLEELMSVLPIRPRGEDGKTLPDSAPYKAYKGDSNYCYELFINERGRWDGELISTFRANQAAYRRFRNDPARFRRYTAGGRPLLMRLCINDYIAVGTAAERTIFRVVKMSENKITLAEHFEGGTLKQRDADKDDPFKYLTKSPGALRDLGARRIFVDLIGRVLDPGIKGD

SEQ ID NO: 85 - skipped

SEQ ID NO: 86 - protein, 1059 aa, Wolinella succinogenes DSM 1740
MIERILGVDLGISSLGWAIVEYDKDDEAANRIIDCGVRLFTAAETPKKKESPNKARREARGIRRVLNRRRVRMNMIKKLFLRAGLIQDVDLDGEGGMFYSKANRADVWELRHDGLYRLLKGDELARVLIHIAKHRGYKFIGDDEADEESGKVKKAGVVLRQNFEAAGCRTVGEWLWRERGANGKKRNKHGDYEISIHRDLLVEEVEAIFVAQQEMRSTIATDALKAAYREIAFFVRPMQRIEKMVGHCTYFPEERRAPKSAPTAEKFIAISKFFSTVIIDNEGWEQKIIERKTLEELLDFAVSREKVEFRHLRKFLDLSDNEIFKGLHYKGKPKTAKKREATLFDPNEPTELEFDKVEAEKKAWISLRGAAKLREALGNEFYGRFVALGKHADEATKILTYYKDEGQKRRELTKLPLEAEMVERLVKIGFSDFLKLSLKAIRDILPAMESGARYDEAVLMLGVPHKEKSAILPPLNKTDIDILNPTVIRAFAQFRKVANALVRKYGAFDRVHFELAREINTKGEIEDIKESQRKNEKERKEAADWIAETSFQVPLTRKNILKKRLYIQQDGRCAYTGDVIELERLFDEGYCEIDHILPRSRSADDSFANKVLCLARANQQKTDRTPYEWFGHDAARWNAFETRTSAPSNRVRTGKGKIDRLLKKNFDENSEMAFKDRNLNDTRYMARAIKTYCEQYWVFKNSHTKAPVQVRSGKLTSVLRYQWGLESKDRESHTHHAVDAIIIAFSTQGMVQKLSEYYRFKETHREKERPKLAVPLANFRDAVEEATRIENTETVKEGVEVKRLLISRPPRARVTGQAHEQTAKPYPRIKQVKNKKKWRLAPIDEEKFESFKADRVASANQKNFYETSTIPRVDVYHKKGKFHLVPIYLHEMVLNELPNLSLGTNPEAMDENFFKFSIFKDDLISIQTQGTPKKPAKIIMGYFKNMHGANMVLSSINNSPCEGFTCTPVSMDKKHKDKCKLCPEENRIAGRCLQGFLDYWSQEGLRPPRKEFECDQGVKFALDVKKYQIDPLGYYYEVKQEKRLGTIPQMRSAKKLVKK

SEQ ID NO: 87 - protein, 1269 aa, Mycoplasma gallisepticum str. F
MNNSIKSKPEVTIGLDLGVGSVGWAIVDNETNIIHHLGSRLFSQAKTAEDRRSFRGVRRLIRRRKYKLKRFVNLIWKYNSYFGFKNKEDILNNYQEQQKLHNTVLNLKSEALNAKIDPKALSWILHDYLKNRGHFYEDNRDFNVYPTKELAKYFDKYGYYKGIIDSKEDNDNKLEEELTKYKFSNKHWLEEVKKVLSNQTGLPEKFKEEYESLFSYVRNYSEGPGSINSVSPYGIYHLDEKEGKVVQKYNNIWDKTIGKCNIFPDEYRAPKNSPIAMIFNEINELSTIRSYSIYLTGWFINQEFKKAYLNKLLDLLIKTNGEKPIDARQFKKLREETIAESIGKETLKDVENEEKLEKEDHKWKLKGLKLNTNGKIQYNDLSSLAKFVHKLKQHLKLDFLLEDQYATLDKINFLQSLFVYLGKHLRYSNRVDSANLKEFSDSNKLFERILQKQKDGLFKLFEQTDKDDEKILAQTHSLSTKAMLLAITRMTNLDNDEDNQKNNDKGWNFEAIKNFDQKFIDITKKNNNLSLKQNKRYLDDRFINDAILSPGVKRILREATKVFNAILKQFSEEYDVTKVVIELARELSEEKELENTKNYKKLIKKNGDKISEGLKALGISEDEIKDILKSPTKSYKFLLWLQQDHIDPYSLKEIAFDDIFTKTEKFEIDHIIPYSISFDDSSSNKLLVLAESNQAKSNQTPYEFISSGNAGIKWEDYEAYCRKFKDGDSSLLDSTQRSKKFAKMMKTDTSSKYDIGFLARNLNDTRYATIVFRDALEDYANNHLVEDKPMFKVVCINGSVTSFLRKNFDDSSYAKKDRDKNIHHAVDASIISIFSNETKTLFNQLTQFADYKLFKNTDGSWKKIDPKTGVVTEVTDENWKQIRVRNQVSEIAKVIEKYIQDSNIERKARYSRKIENKTNISLFNDTVYSAKKVGYEDQIKRKNLKTLDIHESAKENKNSKVKRQFVYRKLVNVSLLNNDKLADLFAEKEDILMYRANPWVINLAEQIFNEYTENKKIKSQNVFEKYMLDLTKEFPEKFSEFLVKSMLRNKTAIIYDDKKNIVHRIKRLKMLSSELKENKLSNVIIRSKNQSGTKLSYQDTINSLALMIMRSIDPTAKKQYIRVPLNTLNLHLGDHDFDLHNMDAYLKKPKFVKYLKANEIGDEYKPWRVLTSGTLLIHKKDKKLMYISSFQNLNDVIEIKNLIETEYKENDDSDSKKKKKANRFLMTLSTILNDYILLDAKDNFDILGLSKNRIDEILNSKLGLDKIVK

SEQ ID NO: 88 - protein, 1138 aa, Acidothermus cellulolyticus 11B
MGGSEVGTVPVTWRLGVDVGERSIGLAAVSYEEDKPKEILAAVSWIHDGGVGDERSGASRLALRGMARRARRLRRFRRARLRDLDMLLSELGWTPLPDKNVSPVDAWLARKRLAEEYVVDETERRRLLGYAVSHMARHRGWRNPWTTIKDLKNLPQPSDSWERTRESLEARYSVSLEPGTVGQWAGYLLQRAPGIRLNPTQQSAGRRAELSNATAFETRLRQEDVLWELRCIADVQGLPEDVVSNVIDAVFCQKRPSVPAERIGRDPLDPSQLRASRACLEFQEYRIVAAVANLRIRDGSGSRPLSLEERNAVIEALLAQTERSLTWSDIALEILKLPNESDLTSVPEEDGPSSLAYSQFAPFDETSARIAEFIAKNRRKIPTFAQWWQEQDRTSRSDLVAALADNSIAGEEEQELLVHLPDAELEALEGLALPSGRVAYSRLTLSGLTRVMRDDGVDVHNARKTCFGVDDNWRPPLPALHEATGHPVVDRNLAILRKFLSSATMRWGPPQSIVVELARGASESRERQAEEEAARRAHRKANDRIRAELRASGLSDPSPADLVRARLLELYDCHCMYCGAPISWENSELDHIVPRTDGGSNRHENLAITCGACNKEKGRRPFASWAETSNRVQLRDVIDRVQKLKYSGNMYWTRDEFSRYKKSVVARLKRRTSDPEVIQSIESTGYAAVALRDRLLSYGEKNGVAQVAVFRGGVTAEARRWLDISIERLFSRVAIFAQSTSTKRLDRRHHAVDAVVLTTLTPGVAKTLADARSRRVSAEFWRRPSDVNRHSTEEPQSPAYRQWKESCSGLGDLLISTAARDSIAVAAPLRLRPTGALHEETLRAFSEHTVGAAWKGAELRRIVEPEVYAAFLALTDPGGRFLKVSPSEDVLPADENRHIVLSDRVLGPRDRVKLFPDDRGSIRVRGGAAYIASFHHARVFRWGSSHSPSFALLRVSLADLAVAGLLRDGVDVFTAELPPWTPAWRYASIALVKAVESGDAKQVGWLVPGDELDFGPEGVTTAAGDLSMFLKYFPERHWVVTGFEDDKRINLKPAFLSAEQAEVLRTERSDRPDTLTEAGEILAQFFPRCWRATVAKVLCHPGLTVIRRTALGQPRWRRGHLPYSWRPWSADPWSGGTP

SEQ ID NO: 89 - protein, 1265 aa, Mycoplasma ovipneumoniae SC01
MHNKKNITIGFDLGIASIGWAIIDSTTSKILDWGTRTFEERKTANERRAFRSTRRNIRRKAYRNQRFINLILKYKDLFELKNISDIQRANKKDTENYEKIISFFTEIYKKCAAKHSNILEVKVKALDSKIEKLDLIWILHDYLENRGFFYDLEEENVADKYEGIEHPSILLYDFFKKNGFFKSNSSIPKDLGGYSFSNLQWVNEIKKLFEVQEINPEFSEKFLNLFTSVRDYAKGPGSEHSASEYGIFQKDEKGKVFKKYDNIWDKTIGKCSFFVEENRSPVNYPSYEIFNLLNQLINLSTDLKTTNKKIWQLSSNDRNELLDELLKVKEKAKIISISLKKNEIKKIILKDFGFEKSDIDDQDTIEGRKIIKEEPTTKLEVTKHLLATIYSHSSDSNWININNILEFLPYLDAICIILDREKSRGQDEVLKKLTEKNIFEVLKIDREKQLDFVKSIFSNTKFNFKKIGNFSLKAIREFLPKMFEQNKNSEYLKWKDEEIRRKWEEQKSKLGKTDKKTKYLNPRIFQDEIISPGTKNTFEQAVLVLNQIIKKYSKENIIDAIIIESPREKNDKKTIEEIKKRNKKGKGKTLEKLFQILNLENKGYKLSDLETKPAKLLDRLRFYHQQDGIDLYTLDKINIDQLINGSQKYEIEHIIPYSMSYDNSQANKILTEKAENLKKGKLIASEYIKRNGDEFYNKYYEKAKELFINKYKKNKKLDSYVDLDEDSAKNRFRFLTLQDYDEFQVEFLARNLNDTRYSTKLFYHALVEHFENNEFFTYIDENSSKHKVKISTIKGHVTKYFRAKPVQKNNGPNENLNNNKPEKIEKNRENNEHHAVDAAIVAIIGNKNPQIANLLTLADNKTDKKFLLHDENYKENIETGELVKIPKFEVDKLAKVEDLKKIIQEKYEEAKKHTAIKFSRKTRTILNGGLSDETLYGFKYDEKEDKYFKIIKKKLVTSKNEELKKYFENPFGKKADGKSEYTVLMAQSHLSEFNKLKEIFEKYNGFSNKTGNAFVEYMNDLALKEPTLKAEIESAKSVEKLLYYNFKPSDQFTYHDNINNKSFKRFYKNIRIIEYKSIPIKFKILSKHDGGKSFKDTLFSLYSLVYKVYENGKESYKSIPVTSQMRNFGIDEFDFLDENLYNKEKLDIYKSDFAKPIPVNCKPVFVLKKGSILKKKSLDIDDFKETKETEEGNYYFISTISKRFNRDTAYGLKPLKLSVVKPVAEPSTNPIFKEYIPIHLDELGNEYPVKIKEHTDDEKLMCTIK

SEQ ID NO: 90 - RNA, 104 nt, Artificial Sequence
  Synthetic
  misc_feature (1)..(20): n is a, c, g, or u
nnnnnnnnnnnnnnnnnnnnguuuuagagcuaugcugaaaagcauagcaaguuaaaauaaggcuaguccguuaucaacuugaaaaaguggcaccgagucggugc

SEQ ID NO: 91 - RNA, 106 nt, Artificial Sequence
  Synthetic
  misc_feature (1)..(20): n is a, c, g, or u
nnnnnnnnnnnnnnnnnnnnguuuuagagcuaugcuggaaacagcauagcaaguuaaaauaaggcuaguccguuaucaacuugaaaaaguggcaccgagucggugc

SEQ ID NO: 92 - RNA, 116 nt, Artificial Sequence
  Synthetic
  misc_feature (1)..(20): n is a, c, g, or u
nnnnnnnnnnnnnnnnnnnnguuuuagagcuaugcuguuuuggaaacaaaacagcauagcaaguuaaaauaaggcuaguccguuaucaacuugaaaaaguggcaccgagucggugc

SEQ ID NO: 93 - RNA, 96 nt, Artificial Sequence
  Synthetic
  misc_feature (1)..(20): n is a, c, g, or u
nnnnnnnnnnnnnnnnnnnnguauuagagcuagaaauagcaaguuaauauaaggcuaguccguuaucaacuugaaaaaguggcaccgagucggugc

SEQ ID NO: 94 - RNA, 96 nt, Artificial Sequence
  Synthetic
  misc_feature (1)..(20): n is a, c, g, or u
nnnnnnnnnnnnnnnnnnnnguuuaagagcuagaaauagcaaguuuaaauaaggcuaguccguuaucaacuugaaaaaguggcaccgagucggugc

SEQ ID NO: 95 - RNA, 116 nt, Artificial Sequence
  Synthetic
  misc_feature (1)..(20): n is a, c, g, or u
nnnnnnnnnnnnnnnnnnnnguauuagagcuaugcuguauuggaaacaauacagcauagcaaguuaauauaaggcuaguccguuaucaacuugaaaaaguggcaccgagucggugc

SEQ ID NO: 96 - RNA, 47 nt, Artificial Sequence
  Synthetic
aaggcuaguccguuaucaacuugaaaaaguggcaccgagucggugcu

SEQ ID NO: 97 - RNA, 49 nt, Artificial Sequence
  Synthetic
aaggcuaguccguuaucaacuugaaaaaguggcaccgagucgguggugc

SEQ ID NO: 98 - RNA, 51 nt, Artificial Sequence
  Synthetic
aaggcuaguccguuaucaacuugaaaaaguggcaccgagucggugcggauc

SEQ ID NO: 99 - RNA, 31 nt, Artificial Sequence
  Synthetic
aaggcuaguccguuaucaacuugaaaaagug

SEQ ID NO: 100 - RNA, 18 nt, Artificial Sequence
  Synthetic
aaggcuaguccguuauca

SEQ ID NO: 101 - RNA, 12 nt, Artificial Sequence
  Synthetic
aaggcuaguccg

SEQ ID NO: 102 - RNA, 102 nt, Artificial Sequence
  Synthetic
  misc_feature (1)..(20): n is a, c, g, or u
nnnnnnnnnnnnnnnnnnnnguuuuagagcuagaaauagcaaguuaaaauaaggcuaguccguuaucaacuugaaaaaguggcaccgagucggugcuuuuuu

SEQ ID NO: 103 - RNA, 102 nt, Artificial Sequence
  Synthetic
  misc_feature (1)..(20): n is a, c, g, or u
nnnnnnnnnnnnnnnnnnnnguuuuaguacucuggaaacagaaucuacuaaaacaaggcaaaaugccguguuuaucucgucaacuuguuggcgagauuuuuu

SEQ ID NO: 104 - DNA, 6 bp, Neisseria meningitidis
  misc_feature (1)..(2): n is a, c, g, or t
nngrrt

SEQ ID NO: 105 - DNA, 6 bp, Staphylococcus aureus
  misc_feature (1)..(2): n is a, c, g, or t
nngrrv

SEQ ID NO: 106 - DNA, 8 bp, Neisseria meningitidis
  misc_feature (1)..(4): n is a, c, g, or t
nnnngatt

SEQ ID NO: 107 - DNA, 8 bp, Neisseria meningitidis
  misc_feature (1)..(4): n is a, c, g, or t
nnnngctt

SEQ ID NO: 108 - protein, 12 aa, Artificial Sequence
  Synthetic
  misc_feature (2)..(2): Xaa is selected from I, V, M, L and T
  misc_feature (4)..(4): Xaa is selected from  T, I, V, S, N, Y, E and L
  misc_feature (5)..(5): Xaa is selected from N, S, G, A, D, T, R, M and F
  misc_feature (6)..(6): Xaa is selected from S, Y, N and F
  misc_feature (7)..(7): Xaa is selected from V, I, L, C, T and F
  misc_feature (9)..(9): Xaa is selected from W, F, V, Y, S and L
  misc_feature (10)..(10): Xaa is selected from A, S, C, V and G
  misc_feature (11)..(11): Xaa is selected from V, I, L, A, M and H
  misc_feature (12)..(12): Xaa is selected from any amino acid or is absent
DXGXXXXGXXXX

SEQ ID NO: 109 - protein, 12 aa, Artificial Sequence
  Synthetic
  misc_feature (2)..(2): Xaa is selected from I, V, M, L and T
  misc_feature (4)..(4): Xaa is selected from  T, I, V, S, N, Y, E and L
  misc_feature (5)..(5): Xaa is selected from N, S, G, A, D, T, R, M and F
  misc_feature (7)..(7): Xaa is selected from V, I, L, C, T and F
  misc_feature (9)..(9): Xaa is selected from W, F, V, Y, S and L
  misc_feature (10)..(10): Xaa is selected from A, S, C, V and G
  misc_feature (11)..(11): Xaa is selected from V, I, L, A, M and H
  misc_feature (12)..(12): Xaa is selected from any amino acid or is absent
DXGXXSXGXXXX

SEQ ID NO: 110 - protein, 12 aa, Artificial Sequence
  Synthetic
  misc_feature (4)..(4): Xaa is selected from T, I, V, S, N, Y, E and L
  misc_feature (5)..(5): Xaa is selected from N, S, G, A, D, T, R, M and F
  misc_feature (11)..(11): Xaa is selected from V, I, L, A, M and H
  misc_feature (12)..(12): Xaa is selected from any amino acid or is absent
DIGXXSVGWAXX

SEQ ID NO: 111 - protein, 12 aa, Artificial Sequence
  Synthetic
  misc_feature (12)..(12): Xaa is a non-polar alkyl amino acid or a hydroxyl amino acid, e.g., X is selected from V, I, L and T
DIGTNSVGWAVX

SEQ ID NO: 112 - protein, 8 aa, Artificial Sequence
  Synthetic
  misc_feature (2)..(2): Xaa is V or H
  misc_feature (3)..(3): Xaa is I, L or V
  misc_feature (5)..(5): Xaa is M or T
IXXEXARE

SEQ ID NO: 113 - protein, 8 aa, Artificial Sequence
  Synthetic
  misc_feature (3)..(3): Xaa is I, L or V
IVXEMARE

SEQ ID NO: 114 - protein, 8 aa, Artificial Sequence
  Synthetic
  misc_feature (4)..(4): Xaa is H or L
  misc_feature (7)..(7): Xaa is R or V
  misc_feature (8)..(8): Xaa is E or V
HHAXDAXX

SEQ ID NO: 115 - protein, 8 aa, Artificial Sequence
  Synthetic
HHAHDAYL

SEQ ID NO: 116 - protein, 11 aa, Artificial Sequence
  Synthetic
  misc_feature (2)..(2): Xaa is selected from K and P
  misc_feature (4)..(4): Xaa is selected from V, L, I, and F
  misc_feature (5)..(5): Xaa is selected from G, A and S
  misc_feature (6)..(6): Xaa is selected from L, I, V and F
  misc_feature (7)..(7): Xaa is N-terminal RuvC-like domain
  misc_feature (10)..(10): Xaa is selected from D, E, N and Q
KXYXXXXTDXY

SEQ ID NO: 117 - protein, 27 aa, Artificial Sequence
  Synthetic
  misc_feature (1)..(1): Xaa is selected from D, E, Q and N
  misc_feature (2)..(2): Xaa is selected from L, I, R, Q, V, M and K
  misc_feature (3)..(3): Xaa is selected from D and E
  misc_feature (5)..(5): Xaa is selected from I, V, T, A and L
  misc_feature (6)..(6): Xaa is selected from V, Y, I, L, F and W
  misc_feature (8)..(8): Xaa is selected from Q, H, R, K, Y, I, L, F and W
  misc_feature (9)..(9): Xaa is selected from S, A, D, T and K
  misc_feature (10)..(10): Xaa is selected from F, L, V, K, Y, M, I, R, A, E, D and Q
  misc_feature (11)..(11): Xaa is selected from L, R, T, I, V, S, C, Y, K, F and G
  misc_feature (12)..(12): Xaa is selected from K, Q, Y, T, F, L, W, M, A, E, G, and S
  misc_feature (13)..(13): Xaa is selected from D, S, N, R, L and T
  misc_feature (14)..(14): Xaa is selected from D, N and S
  misc_feature (15)..(15): Xaa is selected from S, A, T, G and R
  misc_feature (16)..(16): Xaa is selected from I, L, F, S, R, Y, Q, W, D, K and H
  misc_feature (17)..(17): Xaa is selected from D, S, I, N, E, A, H, F, L, Q, M, G, Y and V
  misc_feature (19)..(19): Xaa is selected from K, L, R, M, T and F
  misc_feature (20)..(20): Xaa is selected from V, L, I, A and T
  misc_feature (21)..(21): Xaa is selected from L, I, V and A
  misc_feature (22)..(22): Xaa is selected from T, V, C, E, S and A
  misc_feature (23)..(23): Xaa is selected from R, F, T, W, E, L, N, C, K, V, S, Q, I, Y, H and A
  misc_feature (24)..(24): Xaa is selected from S, P, R, K, N, A, H, Q, G and L
  misc_feature (25)..(25): Xaa is selected from D, G, T, N, S, K, A, I, E, L, Q, R and Y
  misc_feature (26)..(26): Xaa is selected from K, V, A, E, Y, I, C, L, S, T, G, K, M, D and F
XXXHXXPXXXXXXXXXXNXXXXXXXXN

SEQ ID NO: 118 - protein, 27 aa, Artificial Sequence
  Synthetic
  misc_feature (1)..(1): Xaa is selected from D and E
  misc_feature (2)..(2): Xaa is selected from L, I, R, Q, V, M and K
  misc_feature (3)..(3): Xaa is selected from D and E
  misc_feature (5)..(5): Xaa is selected from I, V, T, A and L
  misc_feature (6)..(6): Xaa is selected from V, Y, I, L, F and W
  misc_feature (8)..(8): Xaa is selected from Q, H, R, K, Y, I, L, F and W
  misc_feature (10)..(10): Xaa is selected from F, L, V, K, Y, M, I, R, A, E, D and Q
  misc_feature (11)..(11): Xaa is selected from L, R, T, I, V, S, C, Y, K, F and G
  misc_feature (12)..(12): Xaa is selected from K, Q, Y, T, F, L, W, M, A, E, G, and S
  misc_feature (16)..(16): Xaa is selected from I, L, F, S, R, Y, Q, W, D, K and H
  misc_feature (17)..(17): Xaa is selected from D, S, I, N, E, A, H, F, L, Q, M, G, Y and V
  misc_feature (22)..(22): Xaa is selected from T, V, C, E, S and A
  misc_feature (23)..(23): Xaa is selected from R, F, T, W, E, L, N, C, K, V, S, Q, I, Y, H and A
  misc_feature (24)..(24): Xaa is selected from S, P, R, K, N, A, H, Q, G and L
  misc_feature (25)..(25): Xaa is selected from D, G, T, N, S, K, A, I, E, L, Q, R and Y
  misc_feature (26)..(26): Xaa is selected from K, V, A, E, Y, I, C, L, S, T, G, K, M, D and F
XXXHXXPXSXXXDDSXXNKVLXXXXXN

SEQ ID NO: 119 - protein, 27 aa, Artificial Sequence
  Synthetic
  misc_feature (1)..(1): Xaa is selected from D and E
  misc_feature (3)..(3): Xaa is selected from D and E
  misc_feature (8)..(8): Xaa is selected from Q, H, R, K, Y, I, L and W
  misc_feature (10)..(10): Xaa is selected from F, L, V, K, Y, M, I, R, A, E, D and Q
  misc_feature (11)..(11): Xaa is selected from L, R, T, I, V, S, C, Y, K, F and G
  misc_feature (12)..(12): Xaa is selected from K, Q, Y, T, F, L, W, M, A, E, G, and S
  misc_feature (16)..(16): Xaa is selected from I, L, F, S, R, Y, Q, W, D, K and H
  misc_feature (17)..(17): Xaa is selected from D, S, I, N, E, A, H, F, L, Q, M, G, Y and V
  misc_feature (23)..(23): Xaa is selected from R, F, T, W, E, L, N, C, K, V, S, Q, I, Y, H and A
  misc_feature (24)..(24): Xaa is selected from S, P, R, K, N, A, H, Q, G and L
  misc_feature (25)..(25): Xaa is selected from D, G, T, N, S, K, A, I, E, L, Q, R and Y
  misc_feature (26)..(26): Xaa is selected from K, V, A, E, Y, I, C, L, S, T, G, K, M, D and F
XVXHIVPXSXXXDDSXXNKVLTXXXXN

SEQ ID NO: 120 - protein, 27 aa, Artificial Sequence
  Synthetic
  misc_feature (2)..(2): Xaa is selected from I and V
  misc_feature (6)..(6): Xaa is selected from I and V
  misc_feature (9)..(9): Xaa is selected from A and S
  misc_feature (11)..(11): Xaa is selected from I and L
  misc_feature (12)..(12): Xaa is selected from K and T
  misc_feature (14)..(14): Xaa is selected from D and N
  misc_feature (19)..(19): Xaa is selected from R, K and L
  misc_feature (22)..(22): Xaa is selected from T and V
  misc_feature (23)..(23): Xaa is selected from S and R
  misc_feature (25)..(25): Xaa is selected from K, D and A
  misc_feature (26)..(26): Xaa is selected from E, K, G and N
DXDHIXPQXFXXDXSIDNXVLXXSXXN

SEQ ID NO: 121 - protein, 34 aa, Artificial Sequence
  Synthetic
  misc_feature (8)..(8): Xaa is selected from K and R
  misc_feature (12)..(12): Xaa is selected from V and T
  misc_feature (13)..(13): Xaa is selected from G and D
  misc_feature (14)..(14): Xaa is selected from E, Q and D
  misc_feature (15)..(15): Xaa is selected from E and D
  misc_feature (19)..(19): Xaa is selected from D, N and H
  misc_feature (20)..(20): Xaa is selected from Y, R and N
  misc_feature (23)..(23): Xaa is selected from Q, D and N
  misc_feature (28)..(28): Xaa is selected from G and E
  misc_feature (30)..(30): Xaa is selected from S and G
  misc_feature (32)..(32): Xaa is selected from D and N
LYYLQNGXDMYXXXXLDIXXLSXYZNRXKXDXVP

SEQ ID NO: 122 - DNA, 5 bp, Streptococcus thermophilus A
  misc_feature (1)..(1): n is a, c, g, or t
  misc_feature (4)..(4): n is a, c, g, or t
nggng

SEQ ID NO: 123 - DNA, 7 bp, Streptococcus thermophilus A
  misc_feature (1)..(2): n is a, c, g, or t
nnagaaw

SEQ ID NO: 124 - DNA, 4 bp, Staphylococcus aureus
  misc_feature (1)..(1): n is a, c, g, or t
naar

SEQ ID NO: 125 - DNA, 5 bp, Staphylococcus aureus
  misc_feature (1)..(2): n is a, c, g, or t
nngrr

SEQ ID NO: 126 - DNA, 6 bp, Staphylococcus aureus
  misc_feature (1)..(2): n is a, c, g, or t
  misc_feature (6)..(6): n is a, c, g, or t
nngrrn

SEQ ID NO: 127 - DNA, 7 bp, Neisseria meningitidis
  misc_feature (1)..(3): n is a, c, g, or t
nnngctt

SEQ ID NO: 128 - protein, 20 aa, Artificial Sequence
  Synthetic
  misc_feature (3)..(20): "Gly-Ser" may or may not be present
GSGSGSGSGSGSGSGSGSGS

SEQ ID NO: 129 - protein, 30 aa, Artificial Sequence; identical to SEQ ID NO: 1
  Synthetic
  misc_feature (4)..(30): "Gly-Gly-Ser" may or may not be present

SEQ ID NO: 130 - protein, 20 aa, Artificial Sequence
  Synthetic
  misc_feature (5)..(20): "Gly-Ser-Gly-Ser" may or may not be present
GSGSGSGSGSGSGSGSGSGS

SEQ ID NO: 131 - protein, 4 aa, Artificial Sequence
  Synthetic
GSGS

SEQ ID NO: 132 - protein, 48 aa, Artificial Sequence; identical to SEQ ID NO: 3
  Synthetic
  misc_feature (13)..(48): "GSAGSAAGSGEF" may or may not be present

SEQ ID NO: 133 - protein, 48 aa, Artificial Sequence; identical to SEQ ID NO: 4
  Synthetic
  misc_feature (13)..(48): "SIVAQLSRPDPA" may or may not be present

SEQ ID NO: 134 - DNA, 6 bp, Treponema denticola
  misc_feature (1)..(1): n is a, c, g, or t
  misc_feature (6)..(6): n is a, c, g, or t
naaaan

SEQ ID NO: 135 - DNA, 7 bp, Streptococcus thermophilus B
  misc_feature (1)..(2): n is a, c, g, or t
nnaaaaw

SEQ ID NO: 136 - DNA, 7 bp, Campylobacter jejuni
  misc_feature (1)..(4): n is a, c, g, or t
nnnnaca

SEQ ID NO: 137 - DNA, 8 bp, Pasteurella multocida
  misc_feature (2)..(4): n is a, c, g, or t
  misc_feature (6)..(7): n is a, c, g, or t
gnnncnna

SEQ ID NO: 138 - DNA, 4107 bp, Streptococcus pyogenes
atggataaaaagtacagcatcgggctggacatcggtacaaactcagtggggtgggccgtgattacggacgagtacaaggtaccctccaaaaaatttaaagtgctgggtaacacggacagacactctataaagaaaaatcttattggagccttgctgttcgactcaggcgagacagccgaagccacaaggttgaagcggaccgccaggaggcggtataccaggagaaagaaccgcatatgctacctgcaagaaatcttcagtaacgagatggcaaaggttgacgatagctttttccatcgcctggaagaatcctttcttgttgaggaagacaagaagcacgaacggcaccccatctttggcaatattgtcgacgaagtggcatatcacgaaaagtacccgactatctaccacctcaggaagaagctggtggactctaccgataaggcggacctcagacttatttatttggcactcgcccacatgattaaatttagaggacatttcttgatcgagggcgacctgaacccggacaacagtgacgtcgataagctgttcatccaacttgtgcagacctacaatcaactgttcgaagaaaaccctataaatgcttcaggagtcgacgctaaagcaatcctgtccgcgcgcctctcaaaatctagaagacttgagaatctgattgctcagttgcccggggaaaagaaaaatggattgtttggcaacctgatcgccctcagtctcggactgaccccaaatttcaaaagtaacttcgacctggccgaagacgctaagctccagctgtccaaggacacatacgatgacgacctcgacaatctgctggcccagattggggatcagtacgccgatctctttttggcagcaaagaacctgtccgacgccatcctgttgagcgatatcttgagagtgaacaccgaaattactaaagcaccccttagcgcatctatgatcaagcggtacgacgagcatcatcaggatctgaccctgctgaaggctcttgtgaggcaacagctccccgaaaaatacaaggaaatcttctttgaccagagcaaaaacggctacgctggctatatagatggtggggccagtcaggaggaattctataaattcatcaagcccattctcgagaaaatggacggcacagaggagttgctggtcaaacttaacagggaggacctgctgcggaagcagcggacctttgacaacgggtctatcccccaccagattcatctgggcgaactgcacgcaatcctgaggaggcaggaggatttttatccttttcttaaagataaccgcgagaaaatagaaaagattcttacattcaggatcccgtactacgtgggacctctcgcccggggcaattcacggtttgcctggatgacaaggaagtcagaggagactattacaccttggaacttcgaagaagtggtggacaagggtgcatctgcccagtctttcatcgagcggatgacaaattttgacaagaacctccctaatgagaaggtgctgcccaaacattctctgctctacgagtactttaccgtctacaatgaactgactaaagtcaagtacgtcaccgagggaatgaggaagccggcattccttagtggagaacagaagaaggcgattgtagacctgttgttcaagaccaacaggaaggtgactgtgaagcaacttaaagaagactactttaagaagatcgaatgttttgacagtgtggaaatttcaggggttgaagaccgcttcaatgcgtcattggggacttaccatgatcttctcaagatcataaaggacaaagacttcctggacaacgaagaaaatgaggatattctcgaagacatcgtcctcaccctgaccctgttcgaagacagggaaatgatagaagagcgcttgaaaacctatgcccacctcttcgacgataaagttatgaagcagctgaagcgcaggagatacacaggatggggaagattgtcaaggaagctgatcaatggaattagggataaacagagtggcaagaccatactggatttcctcaaatctgatggcttcgccaataggaacttcatgcaactgattcacgatgactctcttaccttcaaggaggacattcaaaaggctcaggtgagcgggcagggagactcccttcatgaacacatcgcgaatttggcaggttcccccgctattaaaaagggcatccttcaaactgtcaaggtggtggatgaattggtcaaggtaatgggcagacataagccagaaaatattgtgatcgagatggcccgcgaaaaccagaccacacagaagggccagaaaaatagtagagagcggatgaagaggatcgaggagggcatcaaagagctgggatctcagattctcaaagaacaccccgtagaaaacacacagctgcagaacgaaaaattgtacttgtactatctgcagaacggcagagacatgtacgtcgaccaagaacttgatattaatagactgtccgactatgacgtagaccatatcgtgccccagtccttcctgaaggacgactccattgataacaaagtcttgacaagaagcgacaagaacaggggtaaaagtgataatgtgcctagcgaggaggtggtgaaaaaaatgaagaactactggcgacagctgcttaatgcaaagctcattacacaacggaagttcgataatctgacgaaagcagagagaggtggcttgtctgagttggacaaggcagggtttattaagcggcagctggtggaaactaggcagatcacaaagcacgtggcgcagattttggacagccggatgaacacaaaatacgacgaaaatgataaactgatacgagaggtcaaagttatcacgctgaaaagcaagctggtgtccgattttcggaaagacttccagttctacaaagttcgcgagattaataactaccatcatgctcacgatgcgtacctgaacgctgttgtcgggaccgccttgataaagaagtacccaaagctggaatccgagttcgtatacggggattacaaagtgtacgatgtgaggaaaatgatagccaagtccgagcaggagattggaaaggccacagctaagtacttcttttattctaacatcatgaatttttttaagacggaaattaccctggccaacggagagatcagaaagcggccccttatagagacaaatggtgaaacaggtgaaatcgtctgggataagggcagggatttcgctactgtgaggaaggtgctgagtatgccacaggtaaatatcgtgaaaaaaaccgaagtacagaccggaggattttccaaggaaagcattttgcctaaaagaaactcagacaagctcatcgcccgcaagaaagattgggaccctaagaaatacgggggatttgactcacccaccgtagcctattctgtgctggtggtagctaaggtggaaaaaggaaagtctaagaagctgaagtccgtgaaggaactcttgggaatcactatcatggaaagatcatcctttgaaaagaaccctatcgatttcctggaggctaagggttacaaggaggtcaagaaagacctcatcattaaactgccaaaatactctctcttcgagctggaaaatggcaggaagagaatgttggccagcgccggagagctgcaaaagggaaacgagcttgctctgccctccaaatatgttaattttctctatctcgcttcccactatgaaaagctgaaagggtctcccgaagataacgagcagaagcagctgttcgtcgaacagcacaagcactatctggatgaaataatcgaacaaataagcgagttcagcaaaagggttatcctggcggatgctaatttggacaaagtactgtctgcttataacaagcaccgggataagcctattagggaacaagccgagaatataattcacctctttacactcacgaatctcggagcccccgccgccttcaaatactttgatacgactatcgaccggaaacggtataccagtaccaaagaggtcctcgatgccaccctcatccaccagtcaattactggcctgtacgaaacacggatcgacctctctcaactgggcggcgactag

SEQ ID NO: 139 - protein, 1368 aa, Streptococcus pyogenes [sequence omitted]

SEQ ID NO: 140 - DNA, 3249 bp, Neisseria meningitidis
atggccgccttcaagcccaaccccatcaactacatcctgggcctggacatcggcatcgccagcgtgggctgggccatggtggagatcgacgaggacgagaaccccatctgcctgatcgacctgggtgtgcgcgtgttcgagcgcgctgaggtgcccaagactggtgacagtctggctatggctcgccggcttgctcgctctgttcggcgccttactcgccggcgcgctcaccgccttctgcgcgctcgccgcctgctgaagcgcgagggtgtgctgcaggctgccgacttcgacgagaacggcctgatcaagagcctgcccaacactccttggcagctgcgcgctgccgctctggaccgcaagctgactcctctggagtggagcgccgtgctgctgcacctgatcaagcaccgcggctacctgagccagcgcaagaacgagggcgagaccgccgacaaggagctgggtgctctgctgaagggcgtggccgacaacgcccacgccctgcagactggtgacttccgcactcctgctgagctggccctgaacaagttcgagaaggagagcggccacatccgcaaccagcgcggcgactacagccacaccttcagccgcaaggacctgcaggccgagctgatcctgctgttcgagaagcagaaggagttcggcaacccccacgtgagcggcggcctgaaggagggcatcgagaccctgctgatgacccagcgccccgccctgagcggcgacgccgtgcagaagatgctgggccactgcaccttcgagccagccgagcccaaggccgccaagaacacctacaccgccgagcgcttcatctggctgaccaagctgaacaacctgcgcatcctggagcagggcagcgagcgccccctgaccgacaccgagcgcgccaccctgatggacgagccctaccgcaagagcaagctgacctacgcccaggcccgcaagctgctgggtctggaggacaccgccttcttcaagggcctgcgctacggcaaggacaacgccgaggccagcaccctgatggagatgaaggcctaccacgccatcagccgcgccctggagaaggagggcctgaaggacaagaagagtcctctgaacctgagccccgagctgcaggacgagatcggcaccgccttcagcctgttcaagaccgacgaggacatcaccggccgcctgaaggaccgcatccagcccgagatcctggaggccctgctgaagcacatcagcttcgacaagttcgtgcagatcagcctgaaggccctgcgccgcatcgtgcccctgatggagcagggcaagcgctacgacgaggcctgcgccgagatctacggcgaccactacggcaagaagaacaccgaggagaagatctacctgcctcctatccccgccgacgagatccgcaaccccgtggtgctgcgcgccctgagccaggcccgcaaggtgatcaacggcgtggtgcgccgctacggcagccccgcccgcatccacatcgagaccgcccgcgaggtgggcaagagcttcaaggaccgcaaggagatcgagaagcgccaggaggagaaccgcaaggaccgcgagaaggccgccgccaagttccgcgagtacttccccaacttcgtgggcgagcccaagagcaaggacatcctgaagctgcgcctgtacgagcagcagcacggcaagtgcctgtacagcggcaaggagatcaacctgggccgcctgaacgagaagggctacgtggagatcgaccacgccctgcccttcagccgcacctgggacgacagcttcaacaacaaggtgctggtgctgggcagcgagaaccagaacaagggcaaccagaccccctacgagtacttcaacggcaaggacaacagccgcgagtggcaggagttcaaggcccgcgtggagaccagccgcttcccccgcagcaagaagcagcgcatcctgctgcagaagttcgacgaggacggcttcaaggagcgcaacctgaacgacacccgctacgtgaaccgcttcctgtgccagttcgtggccgaccgcatgcgcctgaccggcaagggcaagaagcgcgtgttcgccagcaacggccagatcaccaacctgctgcgcggcttctggggcctgcgcaaggtgcgcgccgagaacgaccgccaccacgccctggacgccgtggtggtggcctgcagcaccgtggccatgcagcagaagatcacccgcttcgtgcgctacaaggagatgaacgccttcgacggtaaaaccatcgacaaggagaccggcgaggtgctgcaccagaagacccacttcccccagccctgggagttcttcgcccaggaggtgatgatccgcgtgttcggcaagcccgacggcaagcccgagttcgaggaggccgacacccccgagaagctgcgcaccctgctggccgagaagctgagcagccgccctgaggccgtgcacgagtacgtgactcctctgttcgtgagccgcgcccccaaccgcaagatgagcggtcagggtcacatggagaccgtgaagagcgccaagcgcctggacgagggcgtgagcgtgctgcgcgtgcccctgacccagctgaagctgaaggacctggagaagatggtgaaccgcgagcgcgagcccaagctgtacgaggccctgaaggcccgcctggaggcccacaaggacgaccccgccaaggccttcgccgagcccttctacaagtacgacaaggccggcaaccgcacccagcaggtgaaggccgtgcgcgtggagcaggtgcagaagaccggcgtgtgggtgcgcaaccacaacggcatcgccgacaacgccaccatggtgcgcgtggacgtgttcgagaagggcgacaagtactacctggtgcccatctacagctggcaggtggccaagggcatcctgcccgaccgcgccgtggtgcagggcaaggacgaggaggactggcagctgatcgacgacagcttcaacttcaagttcagcctgcaccccaacgacctggtggaggtgatcaccaagaaggcccgcatgttcggctacttcgccagctgccaccgcggcaccggcaacatcaacatccgcatccacgacctggaccacaagatcggcaagaacggcatcctggagggcatcggcgtgaagaccgccctgagcttccagaagtaccagatcgacgagctgggcaaggagatccgcccctgccgcctgaagaagcgccctcctgtgcgctaa

SEQ ID NO: 141 - protein, 1082 aa, Neisseria meningitidis; identical to SEQ ID NO: 63

SEQ ID NO: 142 - protein, 1053 aa, Staphylococcus aureus; identical to SEQ ID NO: 6

SEQ ID NO: 143 - DNA, 3159 bp, Staphylococcus aureus
atgaaaaggaactacattctggggctggacatcgggattacaagcgtggggtatgggattattgactatgaaacaagggacgtgatcgacgcaggcgtcagactgttcaaggaggccaacgtggaaaacaatgagggacggagaagcaagaggggagccaggcgcctgaaacgacggagaaggcacagaatccagagggtgaagaaactgctgttcgattacaacctgctgaccgaccattctgagctgagtggaattaatccttatgaagccagggtgaaaggcctgagtcagaagctgtcagaggaagagttttccgcagctctgctgcacctggctaagcgccgaggagtgcataacgtcaatgaggtggaagaggacaccggcaacgagctgtctacaaaggaacagatctcacgcaatagcaaagctctggaagagaagtatgtcgcagagctgcagctggaacggctgaagaaagatggcgaggtgagagggtcaattaataggttcaagacaagcgactacgtcaaagaagccaagcagctgctgaaagtgcagaaggcttaccaccagctggatcagagcttcatcgatacttatatcgacctgctggagactcggagaacctactatgagggaccaggagaagggagccccttcggatggaaagacatcaaggaatggtacgagatgctgatgggacattgcacctattttccagaagagctgagaagcgtcaagtacgcttataacgcagatctgtacaacgccctgaatgacctgaacaacctggtcatcaccagggatgaaaacgagaaactggaatactatgagaagttccagatcatcgaaaacgtgtttaagcagaagaaaaagcctacactgaaacagattgctaaggagatcctggtcaacgaagaggacatcaagggctaccgggtgacaagcactggaaaaccagagttcaccaatctgaaagtgtatcacgatattaaggacatcacagcacggaaagaaatcattgagaacgccgaactgctggatcagattgctaagatcctgactatctaccagagctccgaggacatccaggaagagctgactaacctgaacagcgagctgacccaggaagagatcgaacagattagtaatctgaaggggtacaccggaacacacaacctgtccctgaaagctatcaatctgattctggatgagctgtggcatacaaacgacaatcagattgcaatctttaaccggctgaagctggtcccaaaaaaggtggacctgagtcagcagaaagagatcccaaccacactggtggacgatttcattctgtcacccgtggtcaagcggagcttcatccagagcatcaaagtgatcaacgccatcatcaagaagtacggcctgcccaatgatatcattatcgagctggctagggagaagaacagcaaggacgcacagaagatgatcaatgagatgcagaaacgaaaccggcagaccaatgaacgcattgaagagattatccgaactaccgggaaagagaacgcaaagtacctgattgaaaaaatcaagctgcacgatatgcaggagggaaagtgtctgtattctctggaggccatccccctggaggacctgctgaacaatccattcaactacgaggtcgatcatattatccccagaagcgtgtccttcgacaattcctttaacaacaaggtgctggtcaagcaggaagagaactctaaaaagggcaataggactcctttccagtacctgtctagttcagattccaagatctcttacgaaacctttaaaaagcacattctgaatctggccaaaggaaagggccgcatcagcaagaccaaaaaggagtacctgctggaagagcgggacatcaacagattctccgtccagaaggattttattaaccggaatctggtggacacaagatacgctactcgcggcctgatgaatctgctgcgatcctatttccgggtgaacaatctggatgtgaaagtcaagtccatcaacggcgggttcacatcttttctgaggcgcaaatggaagtttaaaaaggagcgcaacaaagggtacaagcaccatgccgaagatgctctgattatcgcaaatgccgacttcatctttaaggagtggaaaaagctggacaaagccaagaaagtgatggagaaccagatgttcgaagagaagcaggccgaatctatgcccgaaatcgagacagaacaggagtacaaggagattttcatcactcctcaccagatcaagcatatcaaggatttcaaggactacaagtactctcaccgggtggataaaaagcccaacagagagctgatcaatgacaccctgtatagtacaagaaaagacgataaggggaataccctgattgtgaacaatctgaacggactgtacgacaaagataatgacaagctgaaaaagctgatcaacaaaagtcccgagaagctgctgatgtaccaccatgatcctcagacatatcagaaactgaagctgattatggagcagtacggcgacgagaagaacccactgtataagtactatgaagagactgggaactacctgaccaagtatagcaaaaaggataatggccccgtgatcaagaagatcaagtactatgggaacaagctgaatgcccatctggacatcacagacgattaccctaacagtcgcaacaaggtggtcaagctgtcactgaagccatacagattcgatgtctatctggacaacggcgtgtataaatttgtgactgtcaagaatctggatgtcatcaaaaaggagaactactatgaagtgaatagcaagtgctacgaagaggctaaaaagctgaaaaagattagcaaccaggcagagttcatcgcctccttttacaacaacgacctgattaagatcaatggcgaactgtatagggtcatcggggtgaacaatgatctgctgaaccgcattgaagtgaatatgattgacatcacttaccgagagtatctggaaaacatgaatgataagcgcccccctcgaattatcaaaacaattgcctctaagactcagagtatcaaaaagtactcaaccgacattctgggaaacctgtatgaggtgaagagcaaaaagcaccctcagattatcaaaaagggc

SEQ ID NO: 144 - protein, 12 aa, Artificial Sequence
  Synthetic
SGSETPGTSESA

SEQ ID NO: 145 - protein, 21 aa, Artificial Sequence
  Synthetic
SGSETPGTSESATPEGGSGGS

SEQ ID NO: 146 - protein, 4 aa, Artificial Sequence
  Synthetic
GSGS

SEQ ID NO: 147 - protein, 4 aa, Artificial Sequence
  Synthetic
GGGS

SEQ ID NO: 148 - protein, 5 aa, Artificial Sequence
  Synthetic
GGGGS

SEQ ID NO: 149 - protein, 4 aa, Artificial Sequence
  Synthetic
GGSG

SEQ ID NO: 150 - protein, 12 aa, Artificial Sequence
  Synthetic
SGSETPGTSESA

SEQ ID NO: 151 - protein, 21 aa, Artificial Sequence
  Synthetic
SGSETPGTSESATPEGGSGGS

SEQ ID NO: 152 - protein, 6 aa, Artificial Sequence
  Synthetic
GSGSGS

SEQ ID NO: 153 - protein, 10 aa, Artificial Sequence
  Synthetic
GSGSGSGSGS

SEQ ID NO: 154 - protein, 4 aa, Artificial Sequence
  Synthetic
GGGS

SEQ ID NO: 155 - protein, 5 aa, Artificial Sequence
  Synthetic
GGGGS

SEQ ID NO: 156 - protein, 4 aa, Artificial Sequence
  Synthetic
GGSG

SEQ ID NO: 157 - protein, 8 aa, Artificial Sequence
  Synthetic
GGSGGGSG

SEQ ID NO: 158 - protein, 12 aa, Artificial Sequence
  Synthetic
GGSGGGSGGGSG

SEQ ID NO: 159 - protein, 15 aa, Artificial Sequence
  Synthetic
GGGGSGGGGSGGGGS

SEQ ID NO: 160 - protein, 4 aa, Artificial Sequence
  Synthetic
GGSG

SEQ ID NO: 161 - protein, 6 aa, Artificial Sequence
  Synthetic
GGSGGS

SEQ ID NO: 162 - DNA, 179 bp, Artificial Sequence
  Synthetic
tgcttctgacacaactgtgttcactagcaacctcaaacagacaccatggtgcatctgactcgtgtggagaagtcggccgttactgccctgcagggcaagcttaacgtggatgaagttcgtggtgaggccctgggcaggttggtatcaaggttacaagacaggtttaaggagaccaatag

SEQ ID NO: 163 - DNA, 109 bp, Artificial Sequence
  Synthetic
aacagacaccatggtgcatctgactcgtgtggagaagtcggccgttactgccctgcagggcaagcttaacgtggatgaagttcgtggtgaggccctgggcaggttggta

SEQ ID NO: 164 - DNA, 200 bp, Artificial Sequence
  Synthetic
tccctatcagtgatagagaacgtatgtcgagtttactccctatcagtgatagagaacgtatgtcgagtttactccctatcagtgatagagaaacagacaccatggtgcatctgactcgtgtggagaagtcggccgttactgccctgcagggcaagcttaacgtggatgaagttcgtggtgaggccctgggcaggttggta

SEQ ID NO: 165 - DNA, 200 bp, Artificial Sequence
  Synthetic
aacagacaccatggtgcatctgactcgtgtggagaagtcggccgttactgccctgcagggcaagcttaacgtggatgaagttcgtggtgaggccctgggcaggttggtatccctatcagtgatagagaacgtatgtcgagtttactccctatcagtgatagagaacgtatgtcgagtttactccctatcagtgatagaga

SEQ ID NO: 166 - DNA, 190 bp, Artificial Sequence
  Synthetic
tccctatcagtgatagagaacgtatgttccctatcagtgatagagaacgtatgttccctatcagtgatagagaacgtatgtaacagacaccatggtgcatctgactcgtgtggagaagtcggccgttactgccctgcagggcaagcttaacgtggatgaagttcgtggtgaggccctgggcaggttggta

SEQ ID NO: 167 - DNA, 166 bp, Artificial Sequence
  Synthetic
tccctatcagtgatagagatccctatcagtgatagagatccctatcagtgatagagaaacagacaccatggtgcatctgactcgtgtggagaagtcggccgttactgccctgcagggcaagcttaacgtggatgaagttcgtggtgaggccctgggcaggttggta

SEQ ID NO: 168 - DNA, 20 bp, Artificial Sequence
  Synthetic
gtaacggcagacttctcctc

SEQ ID NO: 169 - DNA, 20 bp, Artificial Sequence
  Synthetic
aaggtgaacgtggatgaagt

SEQ ID NO: 170 - DNA, 200 bp, Artificial Sequence
  Synthetic
tccctatcagtgatagagaacgtatgttccctatcagtgatagagaacgtatgttccctatcagtgatagagaacgtatgtcctcaaacagacaccatggtgcatctgactcgtgtggagaagtcggccgttactgccctgcagggcaagcttaacgtggatgaagttcgtggtgaggccctgggcaggttggtatcaag

SEQ ID NO: 171 - DNA, 200 bp, Artificial Sequence
  Synthetic
cctcaaacagacaccatggtgcatctgactcgtgtggagaagtcggccgttactgccctgcagggcaagcttaacgtggatgaagttcgtggtgaggccctgggcaggttggtatcaagtccctatcagtgatagagaacgtatgttccctatcagtgatagagaacgtatgttccctatcagtgatagagaacgtatgt

SEQ ID NO: 172 - DNA, 199 bp, Artificial Sequence
  Synthetic
tccctatcagtgatagagaacgtatgttccctatcagtgatagagaacgtatgttccctatcagtgatagagaacgtatgttccctatcagtgatagagaacaccatggtgcatctgactcgtgtggagaagtcggccgttactgccctgcagggcaagcttaacgtggatgaagttcgtggtgaggccctgggcaggt

SEQ ID NO: 173 - DNA, 199 bp, Artificial Sequence
  Synthetic
acaccatggtgcatctgactcgtgtggagaagtcggccgttactgccctgcagggcaagcttaacgtggatgaagttcgtggtgaggccctgggcaggttccctatcagtgatagagaacgtatgttccctatcagtgatagagaacgtatgttccctatcagtgatagagaacgtatgttccctatcagtgatagaga

What is claimed is:

1. A Cas9 system comprising
a Cas9 fusion molecule comprising a Cas9 molecule linked to a template binding domain, and a nucleic acid template system comprising a template binding domain partner and a template nucleic acid,
wherein the template binding domain comprises an affinity for the template binding domain partner and does not bind an endogenous nucleic acid of a cell, wherein the template binding domain partner is exogenous to the cell,
wherein the template binding domain is selected from the group consisting of a TetR repressor protein, or a fragment thereof; a LacI repressor protein, or a fragment thereof; a Gal4 repressor protein, or a fragment thereof; and C1 repressor protein, or a fragment thereof; and
wherein the template binding domain partner is a DNA sequence recognized by a DNA binding protein selected from the group consisting of a Tet-O sequence, a Lac operon O1 sequence, a UAS sequence, and an Operator L and R sequence.

2. The Cas9 system of claim 1, wherein the template binding domain of the Cas9 fusion molecule is bound to the template binding domain partner.

3. The Cas9 system of claim 2, wherein the template binding domain of the Cas9 fusion molecule is covalently or non-covalently bound to the template binding domain partner.

4. The Cas9 system of claim 1, wherein the template binding domain partner is linked to the template nucleic acid.

5. The Cas9 system of claim 1, wherein the DNA binding protein comprises a TetR repressor, or a fragment of the TetR repressor, and the DNA comprises at least one Tet-O sequence.

6. The Cas9 system of claim 1, wherein the nucleic acid template system comprises a double stranded nucleic acid sequence or a single stranded nucleic acid sequence.

7. The Cas9 system of claim 1, wherein the template nucleic acid comprises about 50-500 nucleotides of homology with a target nucleic acid.

8. The Cas9 system of claim 1, further comprising a gRNA.

9. A cell, or a population of cells, comprising the Cas9 system of claim 1.

10. An in vitro or ex vivo method of altering a nucleic acid at a target position in a cell, or a population of cells, the method comprising contacting the cell or the population of cells with the Cas9 system of claim 8, wherein the Cas9 molecule comprises an amino acid sequence selected from the group consisting of SEQ ID NOs: 6-89,
wherein the gRNA molecule and Cas9 fusion molecule interact with the nucleic acid, resulting in a cleavage event, wherein the cleavage event is repaired by at least one DNA repair pathway, and
wherein the sequence of the nucleic acid after the cleavage event is different than the sequence of the nucleic acid prior to the cleavage event,
thereby altering the nucleic acid at the target position in the cell, or in the population of cells.

11. The method of claim 10, further comprising contacting the cell, or the population of cells, with a second gRNA molecule,
wherein the second gRNA molecule and the Cas9 fusion molecule interact with the nucleic acid, resulting in a second cleavage event.

12. The method of claim 10, wherein the cell, or population of cells, is from a subject suffering from a disease or disorder selected from the group consisting of a blood disease, an immune disease, a neurological disease, a cancer, an infectious disease, a genetic disease, a disorder caused by aberrant mtDNA, a metabolic disease, a disorder caused by aberrant cell cycle, a disorder caused by aberrant angiogenesis, a disorder cause by aberrant DNA damage repair, or a pain disorder.

13. The method of claim 10, wherein the cell, or population of cells, is from a subject having at least one mutation at the target position.

14. A cell, or a population of cells, altered by the method of claim 10.

15. A pharmaceutical composition comprising the cell, or the population of cells, of claim 14.

16. A pharmaceutical composition comprising the Cas9 system of claim 8.

17. An in vitro or ex vivo method of treating a subject suffering from a disease or disorder, the method comprising contacting a cell, or a population of cells, from the subject with the Cas9 system of claim 8, wherein the Cas9 molecule comprises an amino acid sequence selected from the group consisting of SEQ ID NOs: 6-89,
wherein the gRNA molecule and the Cas9 fusion molecule interact with a nucleic acid at a target position, resulting in a cleavage event,
wherein the cleavage event is repaired by at least one DNA repair pathway, and
wherein the sequence of the nucleic acid after the cleavage event is different than the sequence of the nucleic acid prior to the cleavage event,
thereby treating the subject suffering from the disease or disorder.

* * * * *